United States Patent 11,926,839 (PLATFORM FOR T LYMPHOCYTE GENOME ENGINEERING AND IN VIVO HIGH-THROUGHPUT SCREENING THEREOF) - sequence listing, part 6

SEQ ID NO: 132534 - RNA, 20 nt, Artificial Sequence
  mmSKRIPTE0003313_Rab12_1
  gRNA
aaucaacagcaucggacgug

SEQ ID NO: 132535 - RNA, 20 nt, Artificial Sequence
  mmSKRIPTE0003314_Rab12_2
  gRNA
auaacauacaccccacggag

SEQ ID NO: 132536 - RNA, 20 nt, Artificial Sequence
  mmSKRIPTE0003315_Rab12_3
  gRNA
uccguagcgaggcuacagua

SEQ ID NO: 132537 - RNA, 20 nt, Artificial Sequence
  mmSKRIPTE0003316_Rab12_4
  gRNA
cagcuuuagaagguuccgca

SEQ ID NO: 132538 - RNA, 20 nt, Artificial Sequence
  mmSKRIPTE0003317_Rab12_5
  gRNA
gcaucuguccagcguacgug

SEQ ID NO: 132539 - RNA, 20 nt, Artificial Sequence
  mmSKRIPTE0003318_Rab12_6
  gRNA
auccguaggaugauucguug

SEQ ID NO: 132540 - RNA, 20 nt, Artificial Sequence
  mmSKRIPTE0003319_Rab12_7
  gRNA
ggggacuggacuuagucccg

SEQ ID NO: 132541 - RNA, 20 nt, Artificial Sequence
  mmSKRIPTE0003320_Rab12_8
  gRNA
acaagaccacagaccccgug

SEQ ID NO: 132542 - RNA, 20 nt, Artificial Sequence
  mmSKRIPTE0003321_Rab12_9
  gRNA
ccaaucuugugcccccaccg

SEQ ID NO: 132543 - RNA, 20 nt, Artificial Sequence
  mmSKRIPTE0003322_Mbl2_1
  gRNA
aauuagucacgcuaaaggug

SEQ ID NO: 132544 - RNA, 20 nt, Artificial Sequence
  mmSKRIPTE0003323_Mbl2_2
  gRNA
caaucccagcggcuuccgug

SEQ ID NO: 132545 - RNA, 20 nt, Artificial Sequence
  mmSKRIPTE0003324_Mbl2_3
  gRNA
aaaacauaggucgauaucug

SEQ ID NO: 132546 - RNA, 20 nt, Artificial Sequence
  mmSKRIPTE0003325_Mbl2_4
  gRNA
gcauuccuugugauacugcg

SEQ ID NO: 132547 - RNA, 20 nt, Artificial Sequence
  mmSKRIPTE0003326_Mbl2_5
  gRNA
ggccugcaguaagugcagca

SEQ ID NO: 132548 - RNA, 20 nt, Artificial Sequence
  mmSKRIPTE0003327_Mbl2_6
  gRNA
agccgccagaagaauaaggg

SEQ ID NO: 132549 - RNA, 20 nt, Artificial Sequence
  mmSKRIPTE0003328_Mbl2_7
  gRNA
uaguuuauugcuagaaacgg

SEQ ID NO: 132550 - RNA, 20 nt, Artificial Sequence
  mmSKRIPTE0003329_Mbl2_8
  gRNA
gugcaggagacgcccuucug

SEQ ID NO: 132551 - RNA, 20 nt, Artificial Sequence
  mmSKRIPTE0003330_Mbl2_9
  gRNA
gcccugugcuccgaauucca

SEQ ID NO: 132552 - RNA, 20 nt, Artificial Sequence
  mmSKRIPTE0003331_Adam15_1
  gRNA
gacccagcagcgucuccuag

SEQ ID NO: 132553 - RNA, 20 nt, Artificial Sequence
  mmSKRIPTE0003332_Adam15_2
  gRNA
ucugccggagccuaaccaga

SEQ ID NO: 132554 - RNA, 20 nt, Artificial Sequence
  mmSKRIPTE0003333_Adam15_3
  gRNA
cuuugguccgcagaucacgc

SEQ ID NO: 132555 - RNA, 20 nt, Artificial Sequence
  mmSKRIPTE0003334_Adam15_4
  gRNA
gcgcuguuaagcaauaccug

SEQ ID NO: 132556 - RNA, 20 nt, Artificial Sequence
  mmSKRIPTE0003335_Adam15_5
  gRNA
gguugguagaagaagcgcca

SEQ ID NO: 132557 - RNA, 20 nt, Artificial Sequence
  mmSKRIPTE0003336_Adam15_6
  gRNA
cgccuaagaugcuuguggag

SEQ ID NO: 132558 - RNA, 20 nt, Artificial Sequence
  mmSKRIPTE0003337_Adam15_7
  gRNA
ccaucccuucaucucccgug

SEQ ID NO: 132559 - RNA, 20 nt, Artificial Sequence
  mmSKRIPTE0003338_Adam15_8
  gRNA
acuacaucucgcuuaagcug

SEQ ID NO: 132560 - RNA, 20 nt, Artificial Sequence
  mmSKRIPTE0003339_Adam15_9
  gRNA
gaagccgggcuacagacggg

SEQ ID NO: 132561 - RNA, 20 nt, Artificial Sequence
  mmSKRIPTE0003340_Ilf2_1
  gRNA
auacagcauuaacaguuacg

SEQ ID NO: 132562 - RNA, 20 nt, Artificial Sequence
  mmSKRIPTE0003341_Ilf2_2
  gRNA
guauagcuacagguauaaca

SEQ ID NO: 132563 - RNA, 20 nt, Artificial Sequence
  mmSKRIPTE0003342_Ilf2_3
  gRNA
uccagccuacuuauugcgca

SEQ ID NO: 132564 - RNA, 20 nt, Artificial Sequence
  mmSKRIPTE0003343_Ilf2_4
  gRNA
uaguucuucccagcgaagag

SEQ ID NO: 132565 - RNA, 20 nt, Artificial Sequence
  mmSKRIPTE0003344_Ilf2_5
  gRNA
auugaagaaguccggcaggu

SEQ ID NO: 132566 - RNA, 20 nt, Artificial Sequence
  mmSKRIPTE0003345_Ilf2_6
  gRNA
cuggugugccucacgaucgu

SEQ ID NO: 132567 - RNA, 20 nt, Artificial Sequence
  mmSKRIPTE0003346_Ilf2_7
  gRNA
aacgaccaaugagacucacg

SEQ ID NO: 132568 - RNA, 20 nt, Artificial Sequence
  mmSKRIPTE0003347_Ilf2_8
  gRNA
auaggguagagcguaacucg

SEQ ID NO: 132569 - RNA, 20 nt, Artificial Sequence
  mmSKRIPTE0003348_Ilf2_9
  gRNA
aguuccagccgaagucucgg

SEQ ID NO: 132570 - RNA, 20 nt, Artificial Sequence
  mmSKRIPTE0003349_Bcl10_1
  gRNA
cggaagcagagacguaaccg

SEQ ID NO: 132571 - RNA, 20 nt, Artificial Sequence
  mmSKRIPTE0003350_Bcl10_2
  gRNA
uaggguaaagaagcgcucug

SEQ ID NO: 132572 - RNA, 20 nt, Artificial Sequence
  mmSKRIPTE0003351_Bcl10_3
  gRNA
cccaccgacaggcuuaaccg

SEQ ID NO: 132573 - RNA, 20 nt, Artificial Sequence
  mmSKRIPTE0003352_Bcl10_4
  gRNA
agcgacggggaacuucaggu

SEQ ID NO: 132574 - RNA, 20 nt, Artificial Sequence
  mmSKRIPTE0003353_Bcl10_5
  gRNA
ggaaagccaccagcgacgag

SEQ ID NO: 132575 - RNA, 20 nt, Artificial Sequence
  mmSKRIPTE0003354_Bcl10_6
  gRNA
ucaggcaccacccuucggcg

SEQ ID NO: 132576 - RNA, 20 nt, Artificial Sequence
  mmSKRIPTE0003355_Bcl10_7
  gRNA
cuugcggauuggacgccuga

SEQ ID NO: 132577 - RNA, 20 nt, Artificial Sequence
  mmSKRIPTE0003356_Bcl10_8
  gRNA
cagccaaucaguacuacccu

SEQ ID NO: 132578 - RNA, 20 nt, Artificial Sequence
  mmSKRIPTE0003357_Bcl10_9
  gRNA
guaacacggaggaaaaucgc

SEQ ID NO: 132579 - RNA, 20 nt, Artificial Sequence
  mmSKRIPTE0003358_Irs2_1
  gRNA
gcggaggcacuaccgcugga

SEQ ID NO: 132580 - RNA, 20 nt, Artificial Sequence
  mmSKRIPTE0003359_Irs2_2
  gRNA
acacaccagcccucaucgca

SEQ ID NO: 132581 - RNA, 20 nt, Artificial Sequence
  mmSKRIPTE0003360_Irs2_3
  gRNA
ugccacgauagguuguggcg

SEQ ID NO: 132582 - RNA, 20 nt, Artificial Sequence
  mmSKRIPTE0003361_Irs2_4
  gRNA
augaggccgagugccaucgg

SEQ ID NO: 132583 - RNA, 20 nt, Artificial Sequence
  mmSKRIPTE0003362_Irs2_5
  gRNA
gcaccgagcauccuucggag

SEQ ID NO: 132584 - RNA, 20 nt, Artificial Sequence
  mmSKRIPTE0003363_Irs2_6
  gRNA
gacgacugacucuugcugcg

SEQ ID NO: 132585 - RNA, 20 nt, Artificial Sequence
  mmSKRIPTE0003364_Irs2_7
  gRNA
ccucaacaugucccccagcg

SEQ ID NO: 132586 - RNA, 20 nt, Artificial Sequence
  mmSKRIPTE0003365_Irs2_8
  gRNA
caggcgguauaggucucccg

SEQ ID NO: 132587 - RNA, 20 nt, Artificial Sequence
  mmSKRIPTE0003366_Irs2_9
  gRNA
uauaucgccaucgaugugag

SEQ ID NO: 132588 - RNA, 20 nt, Artificial Sequence
  mmSKRIPTE0003367_Rab20_1
  gRNA
ggaugauagcggccgcuccg

SEQ ID NO: 132589 - RNA, 20 nt, Artificial Sequence
  mmSKRIPTE0003368_Rab20_2
  gRNA
acgcagcccugcgaccacgu

SEQ ID NO: 132590 - RNA, 20 nt, Artificial Sequence
  mmSKRIPTE0003369_Rab20_3
  gRNA
uggugcgcaagucacgugag

SEQ ID NO: 132591 - RNA, 20 nt, Artificial Sequence
  mmSKRIPTE0003370_Rab20_4
  gRNA
cgcaggggucaucuccuccg

SEQ ID NO: 132592 - RNA, 20 nt, Artificial Sequence
  mmSKRIPTE0003371_Rab20_5
  gRNA
auacgcccaccaccaaacug

SEQ ID NO: 132593 - RNA, 20 nt, Artificial Sequence
  mmSKRIPTE0003372_Rab20_6
  gRNA
gcaugaucauagguaccacc

SEQ ID NO: 132594 - RNA, 20 nt, Artificial Sequence
  mmSKRIPTE0003373_Rab20_7
  gRNA
ggguaaauaaccgugagucg

SEQ ID NO: 132595 - RNA, 20 nt, Artificial Sequence
  mmSKRIPTE0003374_Rab20_8
  gRNA
gccggcuuuaacuggcuaug

SEQ ID NO: 132596 - RNA, 20 nt, Artificial Sequence
  mmSKRIPTE0003375_Rab20_9
  gRNA
ugccaccuccggaugcccag

SEQ ID NO: 132597 - RNA, 20 nt, Artificial Sequence
  mmSKRIPTE0003376_F7_1
  gRNA
aagucacauacacaucggcg

SEQ ID NO: 132598 - RNA, 20 nt, Artificial Sequence
  mmSKRIPTE0003377_F7_2
  gRNA
auacaguugaguacccgugu

SEQ ID NO: 132599 - RNA, 20 nt, Artificial Sequence
  mmSKRIPTE0003378_F7_3
  gRNA
gcggauauuaucgaagcagu

SEQ ID NO: 132600 - RNA, 20 nt, Artificial Sequence
  mmSKRIPTE0003379_F7_4
  gRNA
aggcaacgugugccccaaag

SEQ ID NO: 132601 - RNA, 20 nt, Artificial Sequence
  mmSKRIPTE0003380_F7_5
  gRNA
gcaaguacgacgggugacac

SEQ ID NO: 132602 - RNA, 20 nt, Artificial Sequence
  mmSKRIPTE0003381_F7_6
  gRNA
ugugaccuucacugacuacg

SEQ ID NO: 132603 - RNA, 20 nt, Artificial Sequence
  mmSKRIPTE0003382_F7_7
  gRNA
gcagacaggaggcagcuacg

SEQ ID NO: 132604 - RNA, 20 nt, Artificial Sequence
  mmSKRIPTE0003383_F7_8
  gRNA
gcugauuucagcacaccuug

SEQ ID NO: 132605 - RNA, 20 nt, Artificial Sequence
  mmSKRIPTE0003384_F7_9
  gRNA
ccaugugccaugguagugcg

SEQ ID NO: 132606 - RNA, 20 nt, Artificial Sequence
  mmSKRIPTE0003385_Rfx1_1
  gRNA
auaaguuaacaguuccgcag

SEQ ID NO: 132607 - RNA, 20 nt, Artificial Sequence
  mmSKRIPTE0003386_Rfx1_2
  gRNA
aguaccacuauuacggccug

SEQ ID NO: 132608 - RNA, 20 nt, Artificial Sequence
  mmSKRIPTE0003387_Rfx1_3
  gRNA
gguagugcugacagucugcg

SEQ ID NO: 132609 - RNA, 20 nt, Artificial Sequence
  mmSKRIPTE0003388_Rfx1_4
  gRNA
aagaugggacgacgucagug

SEQ ID NO: 132610 - RNA, 20 nt, Artificial Sequence
  mmSKRIPTE0003389_Rfx1_5
  gRNA
uaaguguucgccuuauucag

SEQ ID NO: 132611 - RNA, 20 nt, Artificial Sequence
  mmSKRIPTE0003390_Rfx1_6
  gRNA
uggccaacgguguugccgug

SEQ ID NO: 132612 - RNA, 20 nt, Artificial Sequence
  mmSKRIPTE0003391_Rfx1_7
  gRNA
ggauaauuacgagaccgcug

SEQ ID NO: 132613 - RNA, 20 nt, Artificial Sequence
  mmSKRIPTE0003392_Rfx1_8
  gRNA
ucacacugguagaaacgcug

SEQ ID NO: 132614 - RNA, 20 nt, Artificial Sequence
  mmSKRIPTE0003393_Rfx1_9
  gRNA
agccaccagcgaaacuggcg

SEQ ID NO: 132615 - RNA, 20 nt, Artificial Sequence
  mmSKRIPTE0003394_Zap70_1
  gRNA
aucgccaccauagugcacgu

SEQ ID NO: 132616 - RNA, 20 nt, Artificial Sequence
  mmSKRIPTE0003395_Zap70_2
  gRNA
ugacuguggaacaacguaug

SEQ ID NO: 132617 - RNA, 20 nt, Artificial Sequence
  mmSKRIPTE0003396_Zap70_3
  gRNA
caagcucgauguccgccacg

SEQ ID NO: 132618 - RNA, 20 nt, Artificial Sequence
  mmSKRIPTE0003397_Zap70_4
  gRNA
gcuuaugaaguuaugcagag

SEQ ID NO: 132619 - RNA, 20 nt, Artificial Sequence
  mmSKRIPTE0003398_Zap70_5
  gRNA
gagucccuacagcgacccug

SEQ ID NO: 132620 - RNA, 20 nt, Artificial Sequence
  mmSKRIPTE0003399_Zap70_6
  gRNA
augauguacccacccucacg

SEQ ID NO: 132621 - RNA, 20 nt, Artificial Sequence
  mmSKRIPTE0003400_Zap70_7
  gRNA
ucgcaugcgcaaguauggcg

SEQ ID NO: 132622 - RNA, 20 nt, Artificial Sequence
  mmSKRIPTE0003401_Zap70_8
  gRNA
agucagucucccuucccaug

SEQ ID NO: 132623 - RNA, 20 nt, Artificial Sequence
  mmSKRIPTE0003402_Zap70_9
  gRNA
ggccagaagcccuacaaggu

SEQ ID NO: 132624 - RNA, 20 nt, Artificial Sequence
  mmSKRIPTE0003403_Eef2_1
  gRNA
gacgcgcagauauggcgccg

SEQ ID NO: 132625 - RNA, 20 nt, Artificial Sequence
  mmSKRIPTE0003404_Eef2_2
  gRNA
agggagauggcgcuacggag

SEQ ID NO: 132626 - RNA, 20 nt, Artificial Sequence
  mmSKRIPTE0003405_Eef2_3
  gRNA
agaccgcugacgucaacgcc

SEQ ID NO: 132627 - RNA, 20 nt, Artificial Sequence
  mmSKRIPTE0003406_Eef2_4
  gRNA
uguuaugugugaaucaccgc

SEQ ID NO: 132628 - RNA, 20 nt, Artificial Sequence
  mmSKRIPTE0003407_Eef2_5
  gRNA
cgucagcccugucguccgug

SEQ ID NO: 132629 - RNA, 20 nt, Artificial Sequence
  mmSKRIPTE0003408_Eef2_6
  gRNA
accccgcagcuauauuacac

SEQ ID NO: 132630 - RNA, 20 nt, Artificial Sequence
  mmSKRIPTE0003409_Eef2_7
  gRNA
ccucggcuccgcuagacucg

SEQ ID NO: 132631 - RNA, 20 nt, Artificial Sequence
  mmSKRIPTE0003410_Eef2_8
  gRNA
aguugggaaaucgagucacc

SEQ ID NO: 132632 - RNA, 20 nt, Artificial Sequence
  mmSKRIPTE0003411_Eef2_9
  gRNA
ccucaaucggcuccacguag

SEQ ID NO: 132633 - RNA, 20 nt, Artificial Sequence
  mmSKRIPTE0003412_Pauz1_1
  gRNA
uaggacuccuuacacucccg

SEQ ID NO: 132634 - RNA, 20 nt, Artificial Sequence
  mmSKRIPTE0003413_Pauz1_2
  gRNA
ugcaggcagccaguacggcg

SEQ ID NO: 132635 - RNA, 20 nt, Artificial Sequence
  mmSKRIPTE0003414_Pauz1_3
  gRNA
cgggucaacgacgcuucuug

SEQ ID NO: 132636 - RNA, 20 nt, Artificial Sequence
  mmSKRIPTE0003415_Pauz1_4
  gRNA
gaauggguuacccaucuccg

SEQ ID NO: 132637 - RNA, 20 nt, Artificial Sequence
  mmSKRIPTE0003416_Pauz1_5
  gRNA
ggagcuggcucauacaccaa

SEQ ID NO: 132638 - RNA, 20 nt, Artificial Sequence
  mmSKRIPTE0003417_Pauz1_6
  gRNA
aaaggcgucucgcugccuaa

SEQ ID NO: 132639 - RNA, 20 nt, Artificial Sequence
  mmSKRIPTE0003418_Pauz1_7
  gRNA
aaaaagggcuagacccagcg

SEQ ID NO: 132640 - RNA, 20 nt, Artificial Sequence
  mmSKRIPTE0003419_Pauz1_8
  gRNA
acucacacuccccgcacgug

SEQ ID NO: 132641 - RNA, 20 nt, Artificial Sequence
  mmSKRIPTE0003420_Pauz1_9
  gRNA
agcagcuuuagaaugacacg

SEQ ID NO: 132642 - RNA, 20 nt, Artificial Sequence
  mmSKRIPTE0003421_Nf1_1
  gRNA
uggaugguagacguucagug

SEQ ID NO: 132643 - RNA, 20 nt, Artificial Sequence
  mmSKRIPTE0003422_Nf1_2
  gRNA
aauaaucuacccguguacgu

SEQ ID NO: 132644 - RNA, 20 nt, Artificial Sequence
  mmSKRIPTE0003423_Nf1_3
  gRNA
acuauucuuugaauacaacg

SEQ ID NO: 132645 - RNA, 20 nt, Artificial Sequence
  mmSKRIPTE0003424_Nf1_4
  gRNA
uucagacccuaguuuacggu

SEQ ID NO: 132646 - RNA, 20 nt, Artificial Sequence
  mmSKRIPTE0003425_Nf1_5
  gRNA
aguuuacggaaagcacucgc

SEQ ID NO: 132647 - RNA, 20 nt, Artificial Sequence
  mmSKRIPTE0003426_Nf1_6
  gRNA
ccgauacuuccaaagaggcg

SEQ ID NO: 132648 - RNA, 20 nt, Artificial Sequence
  mmSKRIPTE0003427_Nf1_7
  gRNA
agaaagucaccguugcuccg

SEQ ID NO: 132649 - RNA, 20 nt, Artificial Sequence
  mmSKRIPTE0003428_Nf1_8
  gRNA
gaauucgagugauagcugug

SEQ ID NO: 132650 - RNA, 20 nt, Artificial Sequence
  mmSKRIPTE0003429_Nf1_9
  gRNA
caacuugaaucccauuaacc

SEQ ID NO: 132651 - RNA, 20 nt, Artificial Sequence
  mmSKRIPTE0003430_Suau3_1
  gRNA
aaccugggguuccgacgucg

SEQ ID NO: 132652 - RNA, 20 nt, Artificial Sequence
  mmSKRIPTE0003431_Suau3_2
  gRNA
guaagagaugacguuccgaa

SEQ ID NO: 132653 - RNA, 20 nt, Artificial Sequence
  mmSKRIPTE0003432_Suau3_3
  gRNA
cuggccucuccuagccgacg

SEQ ID NO: 132654 - RNA, 20 nt, Artificial Sequence
  mmSKRIPTE0003433_Suau3_4
  gRNA
gcaccuggucgguguccgag

SEQ ID NO: 132655 - RNA, 20 nt, Artificial Sequence
  mmSKRIPTE0003434_Suau3_5
  gRNA
gagcccuaaccggaucgcug

SEQ ID NO: 132656 - RNA, 20 nt, Artificial Sequence
  mmSKRIPTE0003435_Suau3_6
  gRNA
ggauggcaucucagacgcug

SEQ ID NO: 132657 - RNA, 20 nt, Artificial Sequence
  mmSKRIPTE0003436_Suau3_7
  gRNA
gucaccacaaguacucauag

SEQ ID NO: 132658 - RNA, 20 nt, Artificial Sequence
  mmSKRIPTE0003437_Suau3_8
  gRNA
aguaggugacucguuacaca

SEQ ID NO: 132659 - RNA, 20 nt, Artificial Sequence
  mmSKRIPTE0003438_Suau3_9
  gRNA
uauagccggcuaaggaggug

SEQ ID NO: 132660 - RNA, 20 nt, Artificial Sequence
  mmSKRIPTE0003439_Secum1b_1
  gRNA
uguaaacagaggcagccgcg

SEQ ID NO: 132661 - RNA, 20 nt, Artificial Sequence
  mmSKRIPTE0003440_Secum1b_2
  gRNA
caaugucggagcauuagcag

SEQ ID NO: 132662 - RNA, 20 nt, Artificial Sequence
  mmSKRIPTE0003441_Secum1b_3
  gRNA
uugcacugaggacggcacug

SEQ ID NO: 132663 - RNA, 20 nt, Artificial Sequence
  mmSKRIPTE0003442_Secum1b_4
  gRNA
ggcaguagguuuagacacgu

SEQ ID NO: 132664 - RNA, 20 nt, Artificial Sequence
  mmSKRIPTE0003443_Secum1b_5
  gRNA
gaguacugguggaagcugcg

SEQ ID NO: 132665 - RNA, 20 nt, Artificial Sequence
  mmSKRIPTE0003444_Secum1b_6
  gRNA
ucaaaacguagacucuguug

SEQ ID NO: 132666 - RNA, 20 nt, Artificial Sequence
  mmSKRIPTE0003445_Secum1b_7
  gRNA
ggucggaccugccuaccaug

SEQ ID NO: 132667 - RNA, 20 nt, Artificial Sequence
  mmSKRIPTE0003446_Secum1b_8
  gRNA
gacagguagacgucagaaug

SEQ ID NO: 132668 - RNA, 20 nt, Artificial Sequence
  mmSKRIPTE0003447_Secum1b_9
  gRNA
gccacgauuccuguagaagu

SEQ ID NO: 132669 - RNA, 20 nt, Artificial Sequence
  mmSKRIPTE0003448_Six4_1
  gRNA
ccucagccucucuagccacg

SEQ ID NO: 132670 - RNA, 20 nt, Artificial Sequence
  mmSKRIPTE0003449_Six4_2
  gRNA
uuaaccaacgacgaggucag

SEQ ID NO: 132671 - RNA, 20 nt, Artificial Sequence
  mmSKRIPTE0003450_Six4_3
  gRNA
agcaaccggaggagucacgu

SEQ ID NO: 132672 - RNA, 20 nt, Artificial Sequence
  mmSKRIPTE0003451_Six4_4
  gRNA
guacaaggcgcgcuacaccg

SEQ ID NO: 132673 - RNA, 20 nt, Artificial Sequence
  mmSKRIPTE0003452_Six4_5
  gRNA
gccuagggagaggaucaccg

SEQ ID NO: 132674 - RNA, 20 nt, Artificial Sequence
  mmSKRIPTE0003453_Six4_6
  gRNA
auagaagcucuccauccucg

SEQ ID NO: 132675 - RNA, 20 nt, Artificial Sequence
  mmSKRIPTE0003454_Six4_7
  gRNA
guaacugaaagauuaccuag

SEQ ID NO: 132676 - RNA, 20 nt, Artificial Sequence
  mmSKRIPTE0003455_Six4_8
  gRNA
cuaucuuaauggugacugcg

SEQ ID NO: 132677 - RNA, 20 nt, Artificial Sequence
  mmSKRIPTE0003456_Six4_9
  gRNA
cgagagccacagcuucgagu

SEQ ID NO: 132678 - RNA, 20 nt, Artificial Sequence
  mmSKRIPTE0003457_Prkdc_1
  gRNA
caguagccaacaccguacgc

SEQ ID NO: 132679 - RNA, 20 nt, Artificial Sequence
  mmSKRIPTE0003458_Prkdc_2
  gRNA
gacguugacuacacgcacca

SEQ ID NO: 132680 - RNA, 20 nt, Artificial Sequence
  mmSKRIPTE0003459_Prkdc_3
  gRNA
uggcccuuguaaguagacga

SEQ ID NO: 132681 - RNA, 20 nt, Artificial Sequence
  mmSKRIPTE0003460_Prkdc_4
  gRNA
cacugccugaauaucacgug

SEQ ID NO: 132682 - RNA, 20 nt, Artificial Sequence
  mmSKRIPTE0003461_Prkdc_5
  gRNA
auccaccggagaacaucggg

SEQ ID NO: 132683 - RNA, 20 nt, Artificial Sequence
  mmSKRIPTE0003462_Prkdc_6
  gRNA
ugauaaccguucggccuccg

SEQ ID NO: 132684 - RNA, 20 nt, Artificial Sequence
  mmSKRIPTE0003463_Prkdc_7
  gRNA
auccucagaagcaucugcgu

SEQ ID NO: 132685 - RNA, 20 nt, Artificial Sequence
  mmSKRIPTE0003464_Prkdc_8
  gRNA
uccacauagucuuuguacgu

SEQ ID NO: 132686 - RNA, 20 nt, Artificial Sequence
  mmSKRIPTE0003465_Prkdc_9
  gRNA
agacggugugauccgccagu

SEQ ID NO: 132687 - RNA, 20 nt, Artificial Sequence
  mmSKRIPTE0003466_Ufd1_1
  gRNA
guacuuacugaguugaucga

SEQ ID NO: 132688 - RNA, 20 nt, Artificial Sequence
  mmSKRIPTE0003467_Ufd1_2
  gRNA
ucagaucggaugacacacug

SEQ ID NO: 132689 - RNA, 20 nt, Artificial Sequence
  mmSKRIPTE0003468_Ufd1_3
  gRNA
uggguaauaaauguagcgga

SEQ ID NO: 132690 - RNA, 20 nt, Artificial Sequence
  mmSKRIPTE0003469_Ufd1_4
  gRNA
uggaauuagaucaacaugug

SEQ ID NO: 132691 - RNA, 20 nt, Artificial Sequence
  mmSKRIPTE0003470_Ufd1_5
  gRNA
ugccaguuaguacacugacg

SEQ ID NO: 132692 - RNA, 20 nt, Artificial Sequence
  mmSKRIPTE0003471_Ufd1_6
  gRNA
ccacaguggcuaugccggag

SEQ ID NO: 132693 - RNA, 20 nt, Artificial Sequence
  mmSKRIPTE0003472_Ufd1_7
  gRNA
uguuagucaccacuguugag

SEQ ID NO: 132694 - RNA, 20 nt, Artificial Sequence
  mmSKRIPTE0003473_Ufd1_8
  gRNA
cugacacugguagagcacaa

SEQ ID NO: 132695 - RNA, 20 nt, Artificial Sequence
  mmSKRIPTE0003474_Ufd1_9
  gRNA
aagcgguucuggaagacccg

SEQ ID NO: 132696 - RNA, 20 nt, Artificial Sequence
  mmSKRIPTE0003475_Hes1_1
  gRNA
cacugcguuaggacccaccg

SEQ ID NO: 132697 - RNA, 20 nt, Artificial Sequence
  mmSKRIPTE0003476_Hes1_2
  gRNA
agacccagaccgugggaacg

SEQ ID NO: 132698 - RNA, 20 nt, Artificial Sequence
  mmSKRIPTE0003477_Hes1_3
  gRNA
gugugagggcguuaacaccg

SEQ ID NO: 132699 - RNA, 20 nt, Artificial Sequence
  mmSKRIPTE0003478_Hes1_4
  gRNA
uuccggagcaguaacaacuu

SEQ ID NO: 132700 - RNA, 20 nt, Artificial Sequence
  mmSKRIPTE0003479_Hes1_5
  gRNA
ccugcgucuagaaauuaagu

SEQ ID NO: 132701 - RNA, 20 nt, Artificial Sequence
  mmSKRIPTE0003480_Hes1_6
  gRNA
aagucuggaagaaaucaccg

SEQ ID NO: 132702 - RNA, 20 nt, Artificial Sequence
  mmSKRIPTE0003481_Hes1_7
  gRNA
uaucugggacugcacgcgaa

SEQ ID NO: 132703 - RNA, 20 nt, Artificial Sequence
  mmSKRIPTE0003482_Hes1_8
  gRNA
gcgggcgcagaugaccggua

SEQ ID NO: 132704 - RNA, 20 nt, Artificial Sequence
  mmSKRIPTE0003483_Hes1_9
  gRNA
ggcgaaaggacguaagacug

SEQ ID NO: 132705 - RNA, 20 nt, Artificial Sequence
  mmSKRIPTE0003484_Jak2_1
  gRNA
cagauacggagugucccgug

SEQ ID NO: 132706 - RNA, 20 nt, Artificial Sequence
  mmSKRIPTE0003485_Jak2_2
  gRNA
ucuaagagggagcagcacga

SEQ ID NO: 132707 - RNA, 20 nt, Artificial Sequence
  mmSKRIPTE0003486_Jak2_3
  gRNA
aaaguauuauacacuccacg

SEQ ID NO: 132708 - RNA, 20 nt, Artificial Sequence
  mmSKRIPTE0003487_Jak2_4
  gRNA
aaguagaguaacuuucacgu

SEQ ID NO: 132709 - RNA, 20 nt, Artificial Sequence
  mmSKRIPTE0003488_Jak2_5
  gRNA
augguguagaaacaaacgca

SEQ ID NO: 132710 - RNA, 20 nt, Artificial Sequence
  mmSKRIPTE0003489_Jak2_6
  gRNA
uagcauuacaguucuaccga

SEQ ID NO: 132711 - RNA, 20 nt, Artificial Sequence
  mmSKRIPTE0003490_Jak2_7
  gRNA
uucuuccguagaugagaccg

SEQ ID NO: 132712 - RNA, 20 nt, Artificial Sequence
  mmSKRIPTE0003491_Jak2_8
  gRNA
cggguauuacagacuaacug

SEQ ID NO: 132713 - RNA, 20 nt, Artificial Sequence
  mmSKRIPTE0003492_Jak2_9
  gRNA
ugugcuacgaugcagcccua

SEQ ID NO: 132714 - RNA, 20 nt, Artificial Sequence
  mmSKRIPTE0003493_Pi4k2a_1
  gRNA
aagcauccccaaucucgccg

SEQ ID NO: 132715 - RNA, 20 nt, Artificial Sequence
  mmSKRIPTE0003494_Pi4k2a_2
  gRNA
acacugguacugacuucgug

SEQ ID NO: 132716 - RNA, 20 nt, Artificial Sequence
  mmSKRIPTE0003495_Pi4k2a_3
  gRNA
ugacccgaccuacaaccaag

SEQ ID NO: 132717 - RNA, 20 nt, Artificial Sequence
  mmSKRIPTE0003496_Pi4k2a_4
  gRNA
gaucaaauaugacuguccga

SEQ ID NO: 132718 - RNA, 20 nt, Artificial Sequence
  mmSKRIPTE0003497_Pi4k2a_5
  gRNA
uugaguacaagcuucgaggg

SEQ ID NO: 132719 - RNA, 20 nt, Artificial Sequence
  mmSKRIPTE0003498_Pi4k2a_6
  gRNA
auugauuucuucaucccgcg

SEQ ID NO: 132720 - RNA, 20 nt, Artificial Sequence
  mmSKRIPTE0003499_Pi4k2a_7
  gRNA
gagaacgggacuuucgccug

SEQ ID NO: 132721 - RNA, 20 nt, Artificial Sequence
  mmSKRIPTE0003500_Pi4k2a_8
  gRNA
ugcuuuguaccaaaucuccg

SEQ ID NO: 132722 - RNA, 20 nt, Artificial Sequence
  mmSKRIPTE0003501_Pi4k2a_9
  gRNA
ucgcggccgugaccaauccg

SEQ ID NO: 132723 - RNA, 20 nt, Artificial Sequence
  mmSKRIPTE0003502_Sp3_1
  gRNA
ugguuggaguaucgucacug

SEQ ID NO: 132724 - RNA, 20 nt, Artificial Sequence
  mmSKRIPTE0003503_Sp3_2
  gRNA
ugaacccgcccaucgcgggu

SEQ ID NO: 132725 - RNA, 20 nt, Artificial Sequence
  mmSKRIPTE0003504_Sp3_3
  gRNA
gcucccccgaaugccaacgc

SEQ ID NO: 132726 - RNA, 20 nt, Artificial Sequence
  mmSKRIPTE0003505_Sp3_4
  gRNA
guacucgaacggucacaccc

SEQ ID NO: 132727 - RNA, 20 nt, Artificial Sequence
  mmSKRIPTE0003506_Sp3_5
  gRNA
caggugcugcuacuucaagu

SEQ ID NO: 132728 - RNA, 20 nt, Artificial Sequence
  mmSKRIPTE0003507_Sp3_6
  gRNA
auagcuugacuacuacuagu

SEQ ID NO: 132729 - RNA, 20 nt, Artificial Sequence
  mmSKRIPTE0003508_Sp3_7
  gRNA
ccaaaugcaucaauccugug

SEQ ID NO: 132730 - RNA, 20 nt, Artificial Sequence
  mmSKRIPTE0003509_Sp3_8
  gRNA
agccguacuuccugugcgag

SEQ ID NO: 132731 - RNA, 20 nt, Artificial Sequence
  mmSKRIPTE0003510_Sp3_9
  gRNA
uuauugguaauuuacaacga

SEQ ID NO: 132732 - RNA, 20 nt, Artificial Sequence
  mmSKRIPTE0003511_Mafb_1
  gRNA
cgcgccgaaaguccuaacug

SEQ ID NO: 132733 - RNA, 20 nt, Artificial Sequence
  mmSKRIPTE0003512_Mafb_2
  gRNA
cgcggccaucgcuaaaagcg

SEQ ID NO: 132734 - RNA, 20 nt, Artificial Sequence
  mmSKRIPTE0003513_Mafb_3
  gRNA
acaagauuguaugaaccgca

SEQ ID NO: 132735 - RNA, 20 nt, Artificial Sequence
  mmSKRIPTE0003514_Mafb_4
  gRNA
ugaaccgaagacccaucucg

SEQ ID NO: 132736 - RNA, 20 nt, Artificial Sequence
  mmSKRIPTE0003515_Mafb_5
  gRNA
cggcggacccugaagaaccg

SEQ ID NO: 132737 - RNA, 20 nt, Artificial Sequence
  mmSKRIPTE0003516_Mafb_6
  gRNA
cagaguuagagaaacccggg

SEQ ID NO: 132738 - RNA, 20 nt, Artificial Sequence
  mmSKRIPTE0003517_Mafb_7
  gRNA
ucuccagucagcugacgcgg

SEQ ID NO: 132739 - RNA, 20 nt, Artificial Sequence
  mmSKRIPTE0003518_Mafb_8
  gRNA
auaacuacuguacaacggaa

SEQ ID NO: 132740 - RNA, 20 nt, Artificial Sequence
  mmSKRIPTE0003519_Mafb_9
  gRNA
guggacgacaccgagccagc

SEQ ID NO: 132741 - RNA, 20 nt, Artificial Sequence
  mmSKRIPTE0003520_Pag1_1
  gRNA
cgucggcagagacugaacgg

SEQ ID NO: 132742 - RNA, 20 nt, Artificial Sequence
  mmSKRIPTE0003521_Pag1_2
  gRNA
cuaccaucaucgggaccaug

SEQ ID NO: 132743 - RNA, 20 nt, Artificial Sequence
  mmSKRIPTE0003522_Pag1_3
  gRNA
cucggcgcugucauucuccg

SEQ ID NO: 132744 - RNA, 20 nt, Artificial Sequence
  mmSKRIPTE0003523_Pag1_4
  gRNA
uccaacagcugagauccgug

SEQ ID NO: 132745 - RNA, 20 nt, Artificial Sequence
  mmSKRIPTE0003524_Pag1_5
  gRNA
gcaccgggacagacgacgag

SEQ ID NO: 132746 - RNA, 20 nt, Artificial Sequence
  mmSKRIPTE0003525_Pag1_6
  gRNA
cuguguccugcacuucagcg

SEQ ID NO: 132747 - RNA, 20 nt, Artificial Sequence
  mmSKRIPTE0003526_Pag1_7
  gRNA
guucacgugucaguaugcug

SEQ ID NO: 132748 - RNA, 20 nt, Artificial Sequence
  mmSKRIPTE0003527_Pag1_8
  gRNA
ugcagaugcaguguccaacg

SEQ ID NO: 132749 - RNA, 20 nt, Artificial Sequence
  mmSKRIPTE0003528_Pag1_9
  gRNA
gaauuuaagaaaucucugcg

SEQ ID NO: 132750 - RNA, 20 nt, Artificial Sequence
  mmSKRIPTE0003529_Ptprd_1
  gRNA
gagacuccauggauagcgaa

SEQ ID NO: 132751 - RNA, 20 nt, Artificial Sequence
  mmSKRIPTE0003530_Ptprd_2
  gRNA
gugugccugcagccuauccg

SEQ ID NO: 132752 - RNA, 20 nt, Artificial Sequence
  mmSKRIPTE0003531_Ptprd_3
  gRNA
gucacaugauaacauaugcg

SEQ ID NO: 132753 - RNA, 20 nt, Artificial Sequence
  mmSKRIPTE0003532_Ptprd_4
  gRNA
cgagccgcacuagaauaccu

SEQ ID NO: 132754 - RNA, 20 nt, Artificial Sequence
  mmSKRIPTE0003533_Ptprd_5
  gRNA
aggcugagauuuaccuaccg

SEQ ID NO: 132755 - RNA, 20 nt, Artificial Sequence
  mmSKRIPTE0003534_Ptprd_6
  gRNA
gaagacauuaccugccccag

SEQ ID NO: 132756 - RNA, 20 nt, Artificial Sequence
  mmSKRIPTE0003535_Ptprd_7
  gRNA
cuggcaaugguaucugaucg

SEQ ID NO: 132757 - RNA, 20 nt, Artificial Sequence
  mmSKRIPTE0003536_Ptprd_8
  gRNA
auggccagucccgaacagug

SEQ ID NO: 132758 - RNA, 20 nt, Artificial Sequence
  mmSKRIPTE0003537_Ptprd_9
  gRNA
uugccacgauaacugaacag

SEQ ID NO: 132759 - RNA, 20 nt, Artificial Sequence
  mmSKRIPTE0003538_Rab43_1
  gRNA
aucaucuagcuguuaaggcg

SEQ ID NO: 132760 - RNA, 20 nt, Artificial Sequence
  mmSKRIPTE0003539_Rab43_2
  gRNA
caggucaguaacaagccgag

SEQ ID NO: 132761 - RNA, 20 nt, Artificial Sequence
  mmSKRIPTE0003540_Rab43_3
  gRNA
caguugcuugaagauuuccg

SEQ ID NO: 132762 - RNA, 20 nt, Artificial Sequence
  mmSKRIPTE0003541_Rab43_4
  gRNA
acacacacaagcgcugcgug

SEQ ID NO: 132763 - RNA, 20 nt, Artificial Sequence
  mmSKRIPTE0003542_Rab43_5
  gRNA
ccucacagacuucgcccuag

SEQ ID NO: 132764 - RNA, 20 nt, Artificial Sequence
  mmSKRIPTE0003543_Rab43_6
  gRNA
uugggcugagggaguagacg

SEQ ID NO: 132765 - RNA, 20 nt, Artificial Sequence
  mmSKRIPTE0003544_Rab43_7
  gRNA
agccaugugacuuacccagu

SEQ ID NO: 132766 - RNA, 20 nt, Artificial Sequence
  mmSKRIPTE0003545_Rab43_8
  gRNA
cucacauccucgauccagug

SEQ ID NO: 132767 - RNA, 20 nt, Artificial Sequence
  mmSKRIPTE0003546_Rab43_9
  gRNA
agucuuucuaaggcugacag

SEQ ID NO: 132768 - RNA, 20 nt, Artificial Sequence
  mmSKRIPTE0003547_Klrk1_1
  gRNA
acuucauauaugucacaacg

SEQ ID NO: 132769 - RNA, 20 nt, Artificial Sequence
  mmSKRIPTE0003548_Klrk1_2
  gRNA
ggagcauauaaagacccgaa

SEQ ID NO: 132770 - RNA, 20 nt, Artificial Sequence
  mmSKRIPTE0003549_Klrk1_3
  gRNA
guaguggucaccgaggccug

SEQ ID NO: 132771 - RNA, 20 nt, Artificial Sequence
  mmSKRIPTE0003550_Klrk1_4
  gRNA
acccagcaucuaucucuacg

SEQ ID NO: 132772 - RNA, 20 nt, Artificial Sequence
  mmSKRIPTE0003551_Klrk1_5
  gRNA
acgaccucaagccagcaaag

SEQ ID NO: 132773 - RNA, 20 nt, Artificial Sequence
  mmSKRIPTE0003552_Klrk1_6
  gRNA
uuucugguaugagcacaucg

SEQ ID NO: 132774 - RNA, 20 nt, Artificial Sequence
  mmSKRIPTE0003553_Klrk1_7
  gRNA
agaaacucaucacuugagca

SEQ ID NO: 132775 - RNA, 20 nt, Artificial Sequence
  mmSKRIPTE0003554_Klrk1_8
  gRNA
ugguucagugagaauuacag

SEQ ID NO: 132776 - RNA, 20 nt, Artificial Sequence
  mmSKRIPTE0003555_Klrk1_9
  gRNA
gugaaacuuuguguaaugag

SEQ ID NO: 132777 - RNA, 20 nt, Artificial Sequence
  mmSKRIPTE0003556_Nfkbid_1
  gRNA
uaguuuaccuccaucaccag

SEQ ID NO: 132778 - RNA, 20 nt, Artificial Sequence
  mmSKRIPTE0003557_Nfkbid_2
  gRNA
acaagccugggggugccgug

SEQ ID NO: 132779 - RNA, 20 nt, Artificial Sequence
  mmSKRIPTE0003558_Nfkbid_3
  gRNA
aaaacuccaaaguggcacgg

SEQ ID NO: 132780 - RNA, 20 nt, Artificial Sequence
  mmSKRIPTE0003559_Nfkbid_4
  gRNA
gccacgugucaggacuucug

SEQ ID NO: 132781 - RNA, 20 nt, Artificial Sequence
  mmSKRIPTE0003560_Nfkbid_5
  gRNA
ucgguacaucuguaacaccu

SEQ ID NO: 132782 - RNA, 20 nt, Artificial Sequence
  mmSKRIPTE0003561_Nfkbid_6
  gRNA
gcauacgcugacugucccac

SEQ ID NO: 132783 - RNA, 20 nt, Artificial Sequence
  mmSKRIPTE0003562_Nfkbid_7
  gRNA
ugaucaugacugauccaggu

SEQ ID NO: 132784 - RNA, 20 nt, Artificial Sequence
  mmSKRIPTE0003563_Nfkbid_8
  gRNA
gggccguuccgucuugcacg

SEQ ID NO: 132785 - RNA, 20 nt, Artificial Sequence
  mmSKRIPTE0003564_Nfkbid_9
  gRNA
ggugcggaggaaaagcgugg

SEQ ID NO: 132786 - RNA, 20 nt, Artificial Sequence
  mmSKRIPTE0003565_Smarca4_1
  gRNA
cagcugauucuaacccacga

SEQ ID NO: 132787 - RNA, 20 nt, Artificial Sequence
  mmSKRIPTE0003566_Smarca4_2
  gRNA
guucacaguuccacucggca

SEQ ID NO: 132788 - RNA, 20 nt, Artificial Sequence
  mmSKRIPTE0003567_Smarca4_3
  gRNA
ugccgagucugucgucagag

SEQ ID NO: 132789 - RNA, 20 nt, Artificial Sequence
  mmSKRIPTE0003568_Smarca4_4
  gRNA
ugggcccauacauacgagag

SEQ ID NO: 132790 - RNA, 20 nt, Artificial Sequence
  mmSKRIPTE0003569_Smarca4_5
  gRNA
ccacguuagcugcugcgcug

SEQ ID NO: 132791 - RNA, 20 nt, Artificial Sequence
  mmSKRIPTE0003570_Smarca4_6
  gRNA
uaagcguaagcgagacagcg

SEQ ID NO: 132792 - RNA, 20 nt, Artificial Sequence
  mmSKRIPTE0003571_Smarca4_7
  gRNA
ggcuuccaacaggaggacgu

SEQ ID NO: 132793 - RNA, 20 nt, Artificial Sequence
  mmSKRIPTE0003572_Smarca4_8
  gRNA
gguccuuaacacacacuacg

SEQ ID NO: 132794 - RNA, 20 nt, Artificial Sequence
  mmSKRIPTE0003573_Smarca4_9
  gRNA
ugcccuuguaauccgcacug

SEQ ID NO: 132795 - RNA, 20 nt, Artificial Sequence
  mmSKRIPTE0003574_Hspa8_1
  gRNA
gaaaccggucucauugaacg

SEQ ID NO: 132796 - RNA, 20 nt, Artificial Sequence
  mmSKRIPTE0003575_Hspa8_2
  gRNA
uggaauccaucaucacagcg

SEQ ID NO: 132797 - RNA, 20 nt, Artificial Sequence
  mmSKRIPTE0003576_Hspa8_3
  gRNA
auggacguaaucucuagugc

SEQ ID NO: 132798 - RNA, 20 nt, Artificial Sequence
  mmSKRIPTE0003577_Hspa8_4
  gRNA
cauggccuuguggcuccgcg

SEQ ID NO: 132799 - RNA, 20 nt, Artificial Sequence
  mmSKRIPTE0003578_Hspa8_5
  gRNA
aagagccagaacgcucgccu

SEQ ID NO: 132800 - RNA, 20 nt, Artificial Sequence
  mmSKRIPTE0003579_Hspa8_6
  gRNA
acugcggacuggauaaaagc

SEQ ID NO: 132801 - RNA, 20 nt, Artificial Sequence
  mmSKRIPTE0003580_Hspa8_7
  gRNA
gaagcguaccucggaaaggu

SEQ ID NO: 132802 - RNA, 20 nt, Artificial Sequence
  mmSKRIPTE0003581_Hspa8_8
  gRNA
accuaucaccugaagccacg

SEQ ID NO: 132803 - RNA, 20 nt, Artificial Sequence
  mmSKRIPTE0003582_Hspa8_9
  gRNA
gcgguuuccaccagaacgca

SEQ ID NO: 132804 - RNA, 20 nt, Artificial Sequence
  mmSKRIPTE0003583_Tfe3_1
  gRNA
gucccggcaaaacacgcacg

SEQ ID NO: 132805 - RNA, 20 nt, Artificial Sequence
  mmSKRIPTE0003584_Tfe3_2
  gRNA
acaacguuccauguaucggg

SEQ ID NO: 132806 - RNA, 20 nt, Artificial Sequence
  mmSKRIPTE0003585_Tfe3_3
  gRNA
agguccagaagggcauccga

SEQ ID NO: 132807 - RNA, 20 nt, Artificial Sequence
  mmSKRIPTE0003586_Tfe3_4
  gRNA
uuguugugaugguucaagcg

SEQ ID NO: 132808 - RNA, 20 nt, Artificial Sequence
  mmSKRIPTE0003587_Tfe3_5
  gRNA
gauagggauuaacccuccag

SEQ ID NO: 132809 - RNA, 20 nt, Artificial Sequence
  mmSKRIPTE0003588_Tfe3_6
  gRNA
ccugccuccuucuaucaccg

SEQ ID NO: 132810 - RNA, 20 nt, Artificial Sequence
  mmSKRIPTE0003589_Tfe3_7
  gRNA
guugguccuagguuaaggca

SEQ ID NO: 132811 - RNA, 20 nt, Artificial Sequence
  mmSKRIPTE0003590_Tfe3_8
  gRNA
ggucagguauucgcucugcg

SEQ ID NO: 132812 - RNA, 20 nt, Artificial Sequence
  mmSKRIPTE0003591_Tfe3_9
  gRNA
aaaaggcaaggucgucccaa

SEQ ID NO: 132813 - RNA, 20 nt, Artificial Sequence
  mmSKRIPTE0003592_Mid2_1
  gRNA
agauuggccggugcgccacg

SEQ ID NO: 132814 - RNA, 20 nt, Artificial Sequence
  mmSKRIPTE0003593_Mid2_2
  gRNA
gugaaaccauccucacaugu

SEQ ID NO: 132815 - RNA, 20 nt, Artificial Sequence
  mmSKRIPTE0003594_Mid2_3
  gRNA
cugcaaaaaacauugccgag

SEQ ID NO: 132816 - RNA, 20 nt, Artificial Sequence
  mmSKRIPTE0003595_Mid2_4
  gRNA
cuauugcuuaagcgucccug

SEQ ID NO: 132817 - RNA, 20 nt, Artificial Sequence
  mmSKRIPTE0003596_Mid2_5
  gRNA
uuucaccagccaucgccugg

SEQ ID NO: 132818 - RNA, 20 nt, Artificial Sequence
  mmSKRIPTE0003597_Mid2_6
  gRNA
cacuaauggaggcuuaagag

SEQ ID NO: 132819 - RNA, 20 nt, Artificial Sequence
  mmSKRIPTE0003598_Mid2_7
  gRNA
gagauguauaguguagcucg

SEQ ID NO: 132820 - RNA, 20 nt, Artificial Sequence
  mmSKRIPTE0003599_Mid2_8
  gRNA
cgauggcuaagugagccaag

SEQ ID NO: 132821 - RNA, 20 nt, Artificial Sequence
  mmSKRIPTE0003600_Mid2_9
  gRNA
auuguagcucagccauauug

SEQ ID NO: 132822 - RNA, 20 nt, Artificial Sequence
  mmSKRIPTE0003601_Mapk1_1
  gRNA
gccgggccugaaauccagcg

SEQ ID NO: 132823 - RNA, 20 nt, Artificial Sequence
  mmSKRIPTE0003602_Mapk1_2
  gRNA
acgaccgucacagugucuaa

SEQ ID NO: 132824 - RNA, 20 nt, Artificial Sequence
  mmSKRIPTE0003603_Mapk1_3
  gRNA
gaagcgcagcauaagucgag

SEQ ID NO: 132825 - RNA, 20 nt, Artificial Sequence
  mmSKRIPTE0003604_Mapk1_4
  gRNA
aagauaacugcaccaccgug

SEQ ID NO: 132826 - RNA, 20 nt, Artificial Sequence
  mmSKRIPTE0003605_Mapk1_5
  gRNA
uuaauccucaacacccugcg

SEQ ID NO: 132827 - RNA, 20 nt, Artificial Sequence
  mmSKRIPTE0003606_Mapk1_6
  gRNA
agucagaugaaugcaccgaa

SEQ ID NO: 132828 - RNA, 20 nt, Artificial Sequence
  mmSKRIPTE0003607_Mapk1_7
  gRNA
gauugcacacaucaccuacg

SEQ ID NO: 132829 - RNA, 20 nt, Artificial Sequence
  mmSKRIPTE0003608_Mapk1_8
  gRNA
cuacgucgaacaccugcccg

SEQ ID NO: 132830 - RNA, 20 nt, Artificial Sequence
  mmSKRIPTE0003609_Mapk1_9
  gRNA
accugcagcagcuaaccugg

SEQ ID NO: 132831 - RNA, 20 nt, Artificial Sequence
  mmSKRIPTE0003610_Kit_1
  gRNA
auaguauuucaaacgaagcg

SEQ ID NO: 132832 - RNA, 20 nt, Artificial Sequence
  mmSKRIPTE0003611_Kit_2
  gRNA
aaucugaauguuaauagccg

SEQ ID NO: 132833 - RNA, 20 nt, Artificial Sequence
  mmSKRIPTE0003612_Kit_3
  gRNA
ucggcacacguccaaacaug

SEQ ID NO: 132834 - RNA, 20 nt, Artificial Sequence
  mmSKRIPTE0003613_Kit_4
  gRNA
agaacagugugggcuuacgc

SEQ ID NO: 132835 - RNA, 20 nt, Artificial Sequence
  mmSKRIPTE0003614_Kit_5
  gRNA
cuuuacagaauucgauacaa

SEQ ID NO: 132836 - RNA, 20 nt, Artificial Sequence
  mmSKRIPTE0003615_Kit_6
  gRNA
ccuccuguaaaaauacccau

SEQ ID NO: 132837 - RNA, 20 nt, Artificial Sequence
  mmSKRIPTE0003616_Kit_7
  gRNA
ggagacgcugacuaucagcu

SEQ ID NO: 132838 - RNA, 20 nt, Artificial Sequence
  mmSKRIPTE0003617_Kit_8
  gRNA
ucuggagccacuucucuacg

SEQ ID NO: 132839 - RNA, 20 nt, Artificial Sequence
  mmSKRIPTE0003618_Kit_9
  gRNA
aagccgcuguauuugaccgu

SEQ ID NO: 132840 - RNA, 20 nt, Artificial Sequence
  mmSKRIPTE0003619_Cxcl5_1
  gRNA
uaagcggaaugcacucgcag

SEQ ID NO: 132841 - RNA, 20 nt, Artificial Sequence
  mmSKRIPTE0003620_Cxcl5_2
  gRNA
cauccgcaugaauggcgaga

SEQ ID NO: 132842 - RNA, 20 nt, Artificial Sequence
  mmSKRIPTE0003621_Cxcl5_3
  gRNA
ucuaagcucaguuucgaaug

SEQ ID NO: 132843 - RNA, 20 nt, Artificial Sequence
  mmSKRIPTE0003622_Cxcl5_4
  gRNA
aguucauaaagaaaauccgu

SEQ ID NO: 132844 - RNA, 20 nt, Artificial Sequence
  mmSKRIPTE0003623_Cxcl5_5
  gRNA
uuccucagucauagccgcaa

SEQ ID NO: 132845 - RNA, 20 nt, Artificial Sequence
  mmSKRIPTE0003624_Cxcl5_6
  gRNA
guggacaagaucccggacca

SEQ ID NO: 132846 - RNA, 20 nt, Artificial Sequence
  mmSKRIPTE0003625_Cxcl5_7
  gRNA
acuuccaccguagggcacug

SEQ ID NO: 132847 - RNA, 20 nt, Artificial Sequence
  mmSKRIPTE0003626_Cxcl5_8
  gRNA
cauaauguagaaugcaugcg

SEQ ID NO: 132848 - RNA, 20 nt, Artificial Sequence
  mmSKRIPTE0003627_Cxcl5_9
  gRNA
gaauccgggauaagggaugu

SEQ ID NO: 132849 - RNA, 20 nt, Artificial Sequence
  mmSKRIPTE0003628_Thbs4_1
  gRNA
gggcugugcaggcgacaaug

SEQ ID NO: 132850 - RNA, 20 nt, Artificial Sequence
  mmSKRIPTE0003629_Thbs4_2
  gRNA
cuuacguagcacuuucagag

SEQ ID NO: 132851 - RNA, 20 nt, Artificial Sequence
  mmSKRIPTE0003630_Thbs4_3
  gRNA
guacaucaccaucacgcacg

SEQ ID NO: 132852 - RNA, 20 nt, Artificial Sequence
  mmSKRIPTE0003631_Thbs4_4
  gRNA
uguugcagacaccauaccag

SEQ ID NO: 132853 - RNA, 20 nt, Artificial Sequence
  mmSKRIPTE0003632_Thbs4_5
  gRNA
ugaccgcaccucagaucacg

SEQ ID NO: 132854 - RNA, 20 nt, Artificial Sequence
  mmSKRIPTE0003633_Thbs4_6
  gRNA
augccguguacccuguggag

SEQ ID NO: 132855 - RNA, 20 nt, Artificial Sequence
  mmSKRIPTE0003634_Thbs4_7
  gRNA
uguccgauguacggacacca

SEQ ID NO: 132856 - RNA, 20 nt, Artificial Sequence
  mmSKRIPTE0003635_Thbs4_8
  gRNA
agggcagugaaaagauuacg

SEQ ID NO: 132857 - RNA, 20 nt, Artificial Sequence
  mmSKRIPTE0003636_Thbs4_9
  gRNA
ccagcuucuauguagucaug

SEQ ID NO: 132858 - RNA, 20 nt, Artificial Sequence
  mmSKRIPTE0003637_Erbin_1
  gRNA
agccacggacugaagacggu

SEQ ID NO: 132859 - RNA, 20 nt, Artificial Sequence
  mmSKRIPTE0003638_Erbin_2
  gRNA
guaccaugucgcugucuacg

SEQ ID NO: 132860 - RNA, 20 nt, Artificial Sequence
  mmSKRIPTE0003639_Erbin_3
  gRNA
ugccucgcugaacuccacgg

SEQ ID NO: 132861 - RNA, 20 nt, Artificial Sequence
  mmSKRIPTE0003640_Erbin_4
  gRNA
uggcacuagucggucauucg

SEQ ID NO: 132862 - RNA, 20 nt, Artificial Sequence
  mmSKRIPTE0003641_Erbin_5
  gRNA
gggcugaucauacagcagug

SEQ ID NO: 132863 - RNA, 20 nt, Artificial Sequence
  mmSKRIPTE0003642_Erbin_6
  gRNA
gugguaaagcgcuaucacac

SEQ ID NO: 132864 - RNA, 20 nt, Artificial Sequence
  mmSKRIPTE0003643_Erbin_7
  gRNA
uauuuaaaaaaccacccgug

SEQ ID NO: 132865 - RNA, 20 nt, Artificial Sequence
  mmSKRIPTE0003644_Erbin_8
  gRNA
uaaaagggagccgauugcug

SEQ ID NO: 132866 - RNA, 20 nt, Artificial Sequence
  mmSKRIPTE0003645_Erbin_9
  gRNA
gaccccacaaggcguacuga

SEQ ID NO: 132867 - RNA, 20 nt, Artificial Sequence
  mmSKRIPTE0003646_Csf1r_1
  gRNA
uguagaaggcaaaggcaucg

SEQ ID NO: 132868 - RNA, 20 nt, Artificial Sequence
  mmSKRIPTE0003647_Csf1r_2
  gRNA
ccaaagaccccuguucacgu

SEQ ID NO: 132869 - RNA, 20 nt, Artificial Sequence
  mmSKRIPTE0003648_Csf1r_3
  gRNA
caggagaucuggcgucagug

SEQ ID NO: 132870 - RNA, 20 nt, Artificial Sequence
  mmSKRIPTE0003649_Csf1r_4
  gRNA
caaaagauucaagcccaucg

SEQ ID NO: 132871 - RNA, 20 nt, Artificial Sequence
  mmSKRIPTE0003650_Csf1r_5
  gRNA
ucaggguguagacaccuacg

SEQ ID NO: 132872 - RNA, 20 nt, Artificial Sequence
  mmSKRIPTE0003651_Csf1r_6
  gRNA
uucgagcugcuacgucccgg

SEQ ID NO: 132873 - RNA, 20 nt, Artificial Sequence
  mmSKRIPTE0003652_Csf1r_7
  gRNA
cucguggguaauauagcuag

SEQ ID NO: 132874 - RNA, 20 nt, Artificial Sequence
  mmSKRIPTE0003653_Csf1r_8
  gRNA
caagcuggugcggauucgag

SEQ ID NO: 132875 - RNA, 20 nt, Artificial Sequence
  mmSKRIPTE0003654_Csf1r_9
  gRNA
gcugaauuccuacuggucgu

SEQ ID NO: 132876 - RNA, 20 nt, Artificial Sequence
  mmSKRIPTE0003655_Shb_1
  gRNA
uaagcaccgacucaucaaag

SEQ ID NO: 132877 - RNA, 20 nt, Artificial Sequence
  mmSKRIPTE0003656_Shb_2
  gRNA
ccuugugcuauaucaccgug

SEQ ID NO: 132878 - RNA, 20 nt, Artificial Sequence
  mmSKRIPTE0003657_Shb_3
  gRNA
ugaugaguacgaccagccgu

SEQ ID NO: 132879 - RNA, 20 nt, Artificial Sequence
  mmSKRIPTE0003658_Shb_4
  gRNA
cugauuaaacgagugaucga

SEQ ID NO: 132880 - RNA, 20 nt, Artificial Sequence
  mmSKRIPTE0003659_Shb_5
  gRNA
agucgcgcuccuucugcgcg

SEQ ID NO: 132881 - RNA, 20 nt, Artificial Sequence
  mmSKRIPTE0003660_Shb_6
  gRNA
gacaccccguacgagccgga

SEQ ID NO: 132882 - RNA, 20 nt, Artificial Sequence
  mmSKRIPTE0003661_Shb_7
  gRNA
agucaguuaucuaggucgga

SEQ ID NO: 132883 - RNA, 20 nt, Artificial Sequence
  mmSKRIPTE0003662_Shb_8
  gRNA
gcuccccaaacgcacccuug

SEQ ID NO: 132884 - RNA, 20 nt, Artificial Sequence
  mmSKRIPTE0003663_Shb_9
  gRNA
ucuccccagaugguaucacg

SEQ ID NO: 132885 - RNA, 20 nt, Artificial Sequence
  mmSKRIPTE0003664_Nppa_1
  gRNA
aagggacacccaucguagug

SEQ ID NO: 132886 - RNA, 20 nt, Artificial Sequence
  mmSKRIPTE0003665_Nppa_2
  gRNA
gucacauugccacuguggcg

SEQ ID NO: 132887 - RNA, 20 nt, Artificial Sequence
  mmSKRIPTE0003666_Nppa_3
  gRNA
agcaccaaggacagacgccg

SEQ ID NO: 132888 - RNA, 20 nt, Artificial Sequence
  mmSKRIPTE0003667_Nppa_4
  gRNA
agagggcagaucuaucggag

SEQ ID NO: 132889 - RNA, 20 nt, Artificial Sequence
  mmSKRIPTE0003668_Nppa_5
  gRNA
gcuugccgguuuaaucacag

SEQ ID NO: 132890 - RNA, 20 nt, Artificial Sequence
  mmSKRIPTE0003669_Nppa_6
  gRNA
cgcacuuagcucccuccccg

SEQ ID NO: 132891 - RNA, 20 nt, Artificial Sequence
  mmSKRIPTE0003670_Nppa_7
  gRNA
uguagaugaguggucuagug

SEQ ID NO: 132892 - RNA, 20 nt, Artificial Sequence
  mmSKRIPTE0003671_Nppa_8
  gRNA
uuggacaccgcacuguacac

SEQ ID NO: 132893 - RNA, 20 nt, Artificial Sequence
  mmSKRIPTE0003672_Nppa_9
  gRNA
aguaccgaagauaacagcca

SEQ ID NO: 132894 - RNA, 20 nt, Artificial Sequence
  mmSKRIPTE0003673_Spp1_1
  gRNA
auucagcuguacucaccggg

SEQ ID NO: 132895 - RNA, 20 nt, Artificial Sequence
  mmSKRIPTE0003674_Spp1_2
  gRNA
caguuaaaugaucaacccgg

SEQ ID NO: 132896 - RNA, 20 nt, Artificial Sequence
  mmSKRIPTE0003675_Spp1_3
  gRNA
auagcuuggcuuauggacug

SEQ ID NO: 132897 - RNA, 20 nt, Artificial Sequence
  mmSKRIPTE0003676_Spp1_4
  gRNA
gugacuugguggugaucuag

SEQ ID NO: 132898 - RNA, 20 nt, Artificial Sequence
  mmSKRIPTE0003677_Spp1_5
  gRNA
ggcaacagggaugacaucga

SEQ ID NO: 132899 - RNA, 20 nt, Artificial Sequence
  mmSKRIPTE0003678_Spp1_6
  gRNA
cucaccgcucuucaugugag

SEQ ID NO: 132900 - RNA, 20 nt, Artificial Sequence
  mmSKRIPTE0003679_Spp1_7
  gRNA
ccgagccccaaggagaucag

SEQ ID NO: 132901 - RNA, 20 nt, Artificial Sequence
  mmSKRIPTE0003680_Spp1_8
  gRNA
acccagauccuauagccaca

SEQ ID NO: 132902 - RNA, 20 nt, Artificial Sequence
  mmSKRIPTE0003681_Spp1_9
  gRNA
cugugaaacaaaucuuggug

SEQ ID NO: 132903 - RNA, 20 nt, Artificial Sequence
  mmSKRIPTE0003682_Hnf1a_1
  gRNA
gcucacuuaugguuggccgu

SEQ ID NO: 132904 - RNA, 20 nt, Artificial Sequence
  mmSKRIPTE0003683_Hnf1a_2
  gRNA
aagauguguaaacauguacg

SEQ ID NO: 132905 - RNA, 20 nt, Artificial Sequence
  mmSKRIPTE0003684_Hnf1a_3
  gRNA
agccugacaagcgagccucg

SEQ ID NO: 132906 - RNA, 20 nt, Artificial Sequence
  mmSKRIPTE0003685_Hnf1a_4
  gRNA
aaacuggaccggcugcagcg

SEQ ID NO: 132907 - RNA, 20 nt, Artificial Sequence
  mmSKRIPTE0003686_Hnf1a_5
  gRNA
cguaccguacaccuagagug

SEQ ID NO: 132908 - RNA, 20 nt, Artificial Sequence
  mmSKRIPTE0003687_Hnf1a_6
  gRNA
ucauuaacuugucgggacgg

SEQ ID NO: 132909 - RNA, 20 nt, Artificial Sequence
  mmSKRIPTE0003688_Hnf1a_7
  gRNA
acagguggcccacggauacg

SEQ ID NO: 132910 - RNA, 20 nt, Artificial Sequence
  mmSKRIPTE0003689_Hnf1a_8
  gRNA
aaagaaauaauggcgugcgu

SEQ ID NO: 132911 - RNA, 20 nt, Artificial Sequence
  mmSKRIPTE0003690_Hnf1a_9
  gRNA
cgugccgggcgauaaucuca

SEQ ID NO: 132912 - RNA, 20 nt, Artificial Sequence
  mmSKRIPTE0003691_Pou2f2_1
  gRNA
agcacccguaggaucauccg

SEQ ID NO: 132913 - RNA, 20 nt, Artificial Sequence
  mmSKRIPTE0003692_Pou2f2_2
  gRNA
caauguggcgccccgcaaag

SEQ ID NO: 132914 - RNA, 20 nt, Artificial Sequence
  mmSKRIPTE0003693_Pou2f2_3
  gRNA
ggaacagcacaacgaccacg

SEQ ID NO: 132915 - RNA, 20 nt, Artificial Sequence
  mmSKRIPTE0003694_Pou2f2_4
  gRNA
aagaguaaucgagagcaccg

SEQ ID NO: 132916 - RNA, 20 nt, Artificial Sequence
  mmSKRIPTE0003695_Pou2f2_5
  gRNA
uuccugugaguguaucccgg

SEQ ID NO: 132917 - RNA, 20 nt, Artificial Sequence
  mmSKRIPTE0003696_Pou2f2_6
  gRNA
acgcaucaacccuugcagug

SEQ ID NO: 132918 - RNA, 20 nt, Artificial Sequence
  mmSKRIPTE0003697_Pou2f2_7
  gRNA
acugacuucugagaaccgug

SEQ ID NO: 132919 - RNA, 20 nt, Artificial Sequence
  mmSKRIPTE0003698_Pou2f2_8
  gRNA
aaagauguuacuaaagcacg

SEQ ID NO: 132920 - RNA, 20 nt, Artificial Sequence
  mmSKRIPTE0003699_Pou2f2_9
  gRNA
aagggguaacugguccacga

SEQ ID NO: 132921 - RNA, 20 nt, Artificial Sequence
  mmSKRIPTE0003700_Sfrp1_1
  gRNA
aggcuaaagugcccuauccg

SEQ ID NO: 132922 - RNA, 20 nt, Artificial Sequence
  mmSKRIPTE0003701_Sfrp1_2
  gRNA
ccccgggucuccgaucgaug

SEQ ID NO: 132923 - RNA, 20 nt, Artificial Sequence
  mmSKRIPTE0003702_Sfrp1_3
  gRNA
gcucacguagucguacucgc

SEQ ID NO: 132924 - RNA, 20 nt, Artificial Sequence
  mmSKRIPTE0003703_Sfrp1_4
  gRNA
aauuccccaccgcauccaug

SEQ ID NO: 132925 - RNA, 20 nt, Artificial Sequence
  mmSKRIPTE0003704_Sfrp1_5
  gRNA
cauguugcucggcgacgucg

SEQ ID NO: 132926 - RNA, 20 nt, Artificial Sequence
  mmSKRIPTE0003705_Sfrp1_6
  gRNA
uuuguaugaaggagguacgu

SEQ ID NO: 132927 - RNA, 20 nt, Artificial Sequence
  mmSKRIPTE0003706_Sfrp1_7
  gRNA
gcggcgauugguuaacugcg

SEQ ID NO: 132928 - RNA, 20 nt, Artificial Sequence
  mmSKRIPTE0003707_Sfrp1_8
  gRNA
gccaggcuaacaagaucuag

SEQ ID NO: 132929 - RNA, 20 nt, Artificial Sequence
  mmSKRIPTE0003708_Sfrp1_9
  gRNA
caaaaagggaggcuaucuag

SEQ ID NO: 132930 - RNA, 20 nt, Artificial Sequence
  mmSKRIPTE0003709_Selp_1
  gRNA
gccagagugugaauacggug

SEQ ID NO: 132931 - RNA, 20 nt, Artificial Sequence
  mmSKRIPTE0003710_Selp_2
  gRNA
aaggaccagcaauagccgug

SEQ ID NO: 132932 - RNA, 20 nt, Artificial Sequence
  mmSKRIPTE0003711_Selp_3
  gRNA
uacaucucccaacaaagccg

SEQ ID NO: 132933 - RNA, 20 nt, Artificial Sequence
  mmSKRIPTE0003712_Selp_4
  gRNA
accauugccaggaaugaucg

SEQ ID NO: 132934 - RNA, 20 nt, Artificial Sequence
  mmSKRIPTE0003713_Selp_5
  gRNA
ugugagagcaaccugccgag

SEQ ID NO: 132935 - RNA, 20 nt, Artificial Sequence
  mmSKRIPTE0003714_Selp_6
  gRNA
ccagccuggauauagagcga

SEQ ID NO: 132936 - RNA, 20 nt, Artificial Sequence
  mmSKRIPTE0003715_Selp_7
  gRNA
ccccucccacgugugaaggu

SEQ ID NO: 132937 - RNA, 20 nt, Artificial Sequence
  mmSKRIPTE0003716_Selp_8
  gRNA
caugugcuaugaugacgcaa

SEQ ID NO: 132938 - RNA, 20 nt, Artificial Sequence
  mmSKRIPTE0003717_Selp_9
  gRNA
aggcugucugauccucuaca

SEQ ID NO: 132939 - RNA, 20 nt, Artificial Sequence
  mmSKRIPTE0003718_Phb_1
  gRNA
acgcgcaguauccggagcug

SEQ ID NO: 132940 - RNA, 20 nt, Artificial Sequence
  mmSKRIPTE0003719_Phb_2
  gRNA
gacucuggaacugaucggag

SEQ ID NO: 132941 - RNA, 20 nt, Artificial Sequence
  mmSKRIPTE0003720_Phb_3
  gRNA
cuuuguauaauggugaggcg

SEQ ID NO: 132942 - RNA, 20 nt, Artificial Sequence
  mmSKRIPTE0003721_Phb_4
  gRNA
gcauguccuauagugacacg

SEQ ID NO: 132943 - RNA, 20 nt, Artificial Sequence
  mmSKRIPTE0003722_Phb_5
  gRNA
gcugaucugaacgauagccu

SEQ ID NO: 132944 - RNA, 20 nt, Artificial Sequence
  mmSKRIPTE0003723_Phb_6
  gRNA
uccacucacaccuaaacacg

SEQ ID NO: 132945 - RNA, 20 nt, Artificial Sequence
  mmSKRIPTE0003724_Phb_7
  gRNA
gcauguguggguacgccuag

SEQ ID NO: 132946 - RNA, 20 nt, Artificial Sequence
  mmSKRIPTE0003725_Phb_8
  gRNA
ggugucauaacuucaacgga

SEQ ID NO: 132947 - RNA, 20 nt, Artificial Sequence
  mmSKRIPTE0003726_Phb_9
  gRNA
uagagccgguauguacaugu

SEQ ID NO: 132948 - RNA, 20 nt, Artificial Sequence
  mmSKRIPTE0003727_Cdc42ep2_1
  gRNA
cucgcacuacaaccgugugu

SEQ ID NO: 132949 - RNA, 20 nt, Artificial Sequence
  mmSKRIPTE0003728_Cdc42ep2_2
  gRNA
cacccuagaagguuccgcag

SEQ ID NO: 132950 - RNA, 20 nt, Artificial Sequence
  mmSKRIPTE0003729_Cdc42ep2_3
  gRNA
gggggccaccaauuacaggg

SEQ ID NO: 132951 - RNA, 20 nt, Artificial Sequence
  mmSKRIPTE0003730_Cdc42ep2_4
  gRNA
auagccaacgauaccaacaa

SEQ ID NO: 132952 - RNA, 20 nt, Artificial Sequence
  mmSKRIPTE0003731_Cdc42ep2_5
  gRNA
uuuauguaggaaucugcacg

SEQ ID NO: 132953 - RNA, 20 nt, Artificial Sequence
  mmSKRIPTE0003732_Cdc42ep2_6
  gRNA
cuugcauccaucuagaagag

SEQ ID NO: 132954 - RNA, 20 nt, Artificial Sequence
  mmSKRIPTE0003733_Cdc42ep2_7
  gRNA
cuagaggcuuagccuccggg

SEQ ID NO: 132955 - RNA, 20 nt, Artificial Sequence
  mmSKRIPTE0003734_Cdc42ep2_8
  gRNA
augugaucaaaguuggccca

SEQ ID NO: 132956 - RNA, 20 nt, Artificial Sequence
  mmSKRIPTE0003735_Cdc42ep2_9
  gRNA
cagaauucccuggucaugug

SEQ ID NO: 132957 - RNA, 20 nt, Artificial Sequence
  mmSKRIPTE0003736_Rapgef1_1
  gRNA
cgcaccucgauauccccaca

SEQ ID NO: 132958 - RNA, 20 nt, Artificial Sequence
  mmSKRIPTE0003737_Rapgef1_2
  gRNA
cccuuccggagaagaagcgu

SEQ ID NO: 132959 - RNA, 20 nt, Artificial Sequence
  mmSKRIPTE0003738_Rapgef1_3
  gRNA
ggcagcacaagaugccugcg

SEQ ID NO: 132960 - RNA, 20 nt, Artificial Sequence
  mmSKRIPTE0003739_Rapgef1_4
  gRNA
agacacgcuaacaucaccac

SEQ ID NO: 132961 - RNA, 20 nt, Artificial Sequence
  mmSKRIPTE0003740_Rapgef1_5
  gRNA
cugcgguagugauuccacgc

SEQ ID NO: 132962 - RNA, 20 nt, Artificial Sequence
  mmSKRIPTE0003741_Rapgef1_6
  gRNA
ucagugaaagagguuucgga

SEQ ID NO: 132963 - RNA, 20 nt, Artificial Sequence
  mmSKRIPTE0003742_Rapgef1_7
  gRNA
cgagcaccgguccaguagag

SEQ ID NO: 132964 - RNA, 20 nt, Artificial Sequence
  mmSKRIPTE0003743_Rapgef1_8
  gRNA
cuccucuggccagaccagcg

SEQ ID NO: 132965 - RNA, 20 nt, Artificial Sequence
  mmSKRIPTE0003744_Rapgef1_9
  gRNA
uaggacgugagggccuccag

SEQ ID NO: 132966 - RNA, 20 nt, Artificial Sequence
  mmSKRIPTE0003745_Rasgrp1_1
  gRNA
uggauuaagcacuaucaccg

SEQ ID NO: 132967 - RNA, 20 nt, Artificial Sequence
  mmSKRIPTE0003746_Rasgrp1_2
  gRNA
gcucuuaacgaaucuaggga

SEQ ID NO: 132968 - RNA, 20 nt, Artificial Sequence
  mmSKRIPTE0003747_Rasgrp1_3
  gRNA
acguacagauauccgucgga

SEQ ID NO: 132969 - RNA, 20 nt, Artificial Sequence
  mmSKRIPTE0003748_Rasgrp1_4
  gRNA
aguguaugcaugauccacgc

SEQ ID NO: 132970 - RNA, 20 nt, Artificial Sequence
  mmSKRIPTE0003749_Rasgrp1_5
  gRNA
uagaggugcagcgcucuccg

SEQ ID NO: 132971 - RNA, 20 nt, Artificial Sequence
  mmSKRIPTE0003750_Rasgrp1_6
  gRNA
acagggguagaccaugaucg

SEQ ID NO: 132972 - RNA, 20 nt, Artificial Sequence
  mmSKRIPTE0003751_Rasgrp1_7
  gRNA
ccaaacagaaucguucccgu

SEQ ID NO: 132973 - RNA, 20 nt, Artificial Sequence
  mmSKRIPTE0003752_Rasgrp1_8
  gRNA
gcugacggugagauucccau

SEQ ID NO: 132974 - RNA, 20 nt, Artificial Sequence
  mmSKRIPTE0003753_Rasgrp1_9
  gRNA
gucccauagcaaaagauccg

SEQ ID NO: 132975 - RNA, 20 nt, Artificial Sequence
  mmSKRIPTE0003754_Rap1a_1
  gRNA
cgguuaagaauaggccaccg

SEQ ID NO: 132976 - RNA, 20 nt, Artificial Sequence
  mmSKRIPTE0003755_Rap1a_2
  gRNA
uggacacugcaggaaccgua

SEQ ID NO: 132977 - RNA, 20 nt, Artificial Sequence
  mmSKRIPTE0003756_Rap1a_3
  gRNA
uaaccugcucaaugccaccg

SEQ ID NO: 132978 - RNA, 20 nt, Artificial Sequence
  mmSKRIPTE0003757_Rap1a_4
  gRNA
augagguaaccugcaaccgu

SEQ ID NO: 132979 - RNA, 20 nt, Artificial Sequence
  mmSKRIPTE0003758_Rap1a_5
  gRNA
gagacagcacuccacuagag

SEQ ID NO: 132980 - RNA, 20 nt, Artificial Sequence
  mmSKRIPTE0003759_Rap1a_6
  gRNA
cauguauagauccagcggua

SEQ ID NO: 132981 - RNA, 20 nt, Artificial Sequence
  mmSKRIPTE0003760_Rap1a_7
  gRNA
aagacacuuaagcagaacgg

SEQ ID NO: 132982 - RNA, 20 nt, Artificial Sequence
  mmSKRIPTE0003761_Rap1a_8
  gRNA
ucaaauuggacaguucacca

SEQ ID NO: 132983 - RNA, 20 nt, Artificial Sequence
  mmSKRIPTE0003762_Rap1a_9
  gRNA
guugguucagaccaucccag

SEQ ID NO: 132984 - RNA, 20 nt, Artificial Sequence
  mmSKRIPTE0003763_Ddx58_1
  gRNA
aggaccaagacuuauaacug

SEQ ID NO: 132985 - RNA, 20 nt, Artificial Sequence
  mmSKRIPTE0003764_Ddx58_2
  gRNA
cagaagguuacaaagucgcg

SEQ ID NO: 132986 - RNA, 20 nt, Artificial Sequence
  mmSKRIPTE0003765_Ddx58_3
  gRNA
gcggugaugagaauaagccc

SEQ ID NO: 132987 - RNA, 20 nt, Artificial Sequence
  mmSKRIPTE0003766_Ddx58_4
  gRNA
augcgucucgguguaccgag

SEQ ID NO: 132988 - RNA, 20 nt, Artificial Sequence
  mmSKRIPTE0003767_Ddx58_5
  gRNA
ugaaugccagauaaccugac

SEQ ID NO: 132989 - RNA, 20 nt, Artificial Sequence
  mmSKRIPTE0003768_Ddx58_6
  gRNA
cagaacuguagccacgacug

SEQ ID NO: 132990 - RNA, 20 nt, Artificial Sequence
  mmSKRIPTE0003769_Ddx58_7
  gRNA
uggcagggucaaauccggaa

SEQ ID NO: 132991 - RNA, 20 nt, Artificial Sequence
  mmSKRIPTE0003770_Ddx58_8
  gRNA
uuaacuuaaggacagcgcgg

SEQ ID NO: 132992 - RNA, 20 nt, Artificial Sequence
  mmSKRIPTE0003771_Ddx58_9
  gRNA
ccgagcgagagcuuacucgg

SEQ ID NO: 132993 - RNA, 20 nt, Artificial Sequence
  mmSKRIPTE0003772_Oas2_1
  gRNA
gcaaaucuaucgccaucugg

SEQ ID NO: 132994 - RNA, 20 nt, Artificial Sequence
  mmSKRIPTE0003773_Oas2_2
  gRNA
ccgcuggauaagucgcagca

SEQ ID NO: 132995 - RNA, 20 nt, Artificial Sequence
  mmSKRIPTE0003774_Oas2_3
  gRNA
uggcugcaugacucccggaa

SEQ ID NO: 132996 - RNA, 20 nt, Artificial Sequence
  mmSKRIPTE0003775_Oas2_4
  gRNA
agagucguaacucuccagcg

SEQ ID NO: 132997 - RNA, 20 nt, Artificial Sequence
  mmSKRIPTE0003776_Oas2_5
  gRNA
ccaaccaccuauagcacgug

SEQ ID NO: 132998 - RNA, 20 nt, Artificial Sequence
  mmSKRIPTE0003777_Oas2_6
  gRNA
ugagcagcuaagcucaauca

SEQ ID NO: 132999 - RNA, 20 nt, Artificial Sequence
  mmSKRIPTE0003778_Oas2_7
  gRNA
uccccagaucacucacguag

SEQ ID NO: 133000 - RNA, 20 nt, Artificial Sequence
  mmSKRIPTE0003779_Oas2_8
  gRNA
aaucggguuaauucagaacg

SEQ ID NO: 133001 - RNA, 20 nt, Artificial Sequence
  mmSKRIPTE0003780_Oas2_9
  gRNA
guuaggcgguggccauucaa

SEQ ID NO: 133002 - RNA, 20 nt, Artificial Sequence
  mmSKRIPTE0003781_Trim21_1
  gRNA
gagccuaugaguaucgaaug

SEQ ID NO: 133003 - RNA, 20 nt, Artificial Sequence
  mmSKRIPTE0003782_Trim21_2
  gRNA
uaauguacccgggagccacg

SEQ ID NO: 133004 - RNA, 20 nt, Artificial Sequence
  mmSKRIPTE0003783_Trim21_3
  gRNA
guccgggaaguaccgucagu

SEQ ID NO: 133005 - RNA, 20 nt, Artificial Sequence
  mmSKRIPTE0003784_Trim21_4
  gRNA
agguggacaagcgaugacac

SEQ ID NO: 133006 - RNA, 20 nt, Artificial Sequence
  mmSKRIPTE0003785_Trim21_5
  gRNA
ugcacuucuucuguaaaccc

SEQ ID NO: 133007 - RNA, 20 nt, Artificial Sequence
  mmSKRIPTE0003786_Trim21_6
  gRNA
ucaugguuaaggcuugcuug

SEQ ID NO: 133008 - RNA, 20 nt, Artificial Sequence
  mmSKRIPTE0003787_Trim21_7
  gRNA
ucugggcaccuagcaccaug

SEQ ID NO: 133009 - RNA, 20 nt, Artificial Sequence
  mmSKRIPTE0003788_Trim21_8
  gRNA
ggucaaaaugaccaagugca

SEQ ID NO: 133010 - RNA, 20 nt, Artificial Sequence
  mmSKRIPTE0003789_Trim21_9
  gRNA
gaacccagggugguaaugug

SEQ ID NO: 133011 - RNA, 20 nt, Artificial Sequence
  mmSKRIPTE0003790_Sox6_1
  gRNA
ucuccugucuccuaaccgga

SEQ ID NO: 133012 - RNA, 20 nt, Artificial Sequence
  mmSKRIPTE0003791_Sox6_2
  gRNA
uugacggaaugaacuguacg

SEQ ID NO: 133013 - RNA, 20 nt, Artificial Sequence
  mmSKRIPTE0003792_Sox6_3
  gRNA
acgcauuggcuuguauagag

SEQ ID NO: 133014 - RNA, 20 nt, Artificial Sequence
  mmSKRIPTE0003793_Sox6_4
  gRNA
ucuuaucaacagugccaacg

SEQ ID NO: 133015 - RNA, 20 nt, Artificial Sequence
  mmSKRIPTE0003794_Sox6_5
  gRNA
uagugccugcuaucagcgau

SEQ ID NO: 133016 - RNA, 20 nt, Artificial Sequence
  mmSKRIPTE0003795_Sox6_6
  gRNA
gcguauccaccacaucggca

SEQ ID NO: 133017 - RNA, 20 nt, Artificial Sequence
  mmSKRIPTE0003796_Sox6_7
  gRNA
ucggaaagaacaaugcgcac

SEQ ID NO: 133018 - RNA, 20 nt, Artificial Sequence
  mmSKRIPTE0003797_Sox6_8
  gRNA
gugggguagguacucccaag

SEQ ID NO: 133019 - RNA, 20 nt, Artificial Sequence
  mmSKRIPTE0003798_Sox6_9
  gRNA
ccucaagguaaacggcaaug

SEQ ID NO: 133020 - RNA, 20 nt, Artificial Sequence
  mmSKRIPTE0003799_Angpt2_1
  gRNA
cuggcuuucucugcgcacaa

SEQ ID NO: 133021 - RNA, 20 nt, Artificial Sequence
  mmSKRIPTE0003800_Angpt2_2
  gRNA
acaaauucagaacugaccga

SEQ ID NO: 133022 - RNA, 20 nt, Artificial Sequence
  mmSKRIPTE0003801_Angpt2_3
  gRNA
ucacagggaagaauguuccg

SEQ ID NO: 133023 - RNA, 20 nt, Artificial Sequence
  mmSKRIPTE0003802_Angpt2_4
  gRNA
gccuacugugacauggacgu

SEQ ID NO: 133024 - RNA, 20 nt, Artificial Sequence
  mmSKRIPTE0003803_Angpt2_5
  gRNA
aaggccguguccucgcacug

SEQ ID NO: 133025 - RNA, 20 nt, Artificial Sequence
  mmSKRIPTE0003804_Angpt2_6
  gRNA
aaaccgugcuuagaggaaug

SEQ ID NO: 133026 - RNA, 20 nt, Artificial Sequence
  mmSKRIPTE0003805_Angpt2_7
  gRNA
acccccuacaggaagauagu

SEQ ID NO: 133027 - RNA, 20 nt, Artificial Sequence
  mmSKRIPTE0003806_Angpt2_8
  gRNA
auacuggggaaaaaugccgc

SEQ ID NO: 133028 - RNA, 20 nt, Artificial Sequence
  mmSKRIPTE0003807_Angpt2_9
  gRNA
ccaugucauccguaagugag

SEQ ID NO: 133029 - RNA, 20 nt, Artificial Sequence
  mmSKRIPTE0003808_Ednra_1
  gRNA
cuauucaagaagcuacacgc

SEQ ID NO: 133030 - RNA, 20 nt, Artificial Sequence
  mmSKRIPTE0003809_Ednra_2
  gRNA
ucagccaaaaguaugccgca

SEQ ID NO: 133031 - RNA, 20 nt, Artificial Sequence
  mmSKRIPTE0003810_Ednra_3
  gRNA
cccaucaacguguuuaaggu

SEQ ID NO: 133032 - RNA, 20 nt, Artificial Sequence
  mmSKRIPTE0003811_Ednra_4
  gRNA
caguccacgagucgucucgg

SEQ ID NO: 133033 - RNA, 20 nt, Artificial Sequence
  mmSKRIPTE0003812_Ednra_5
  gRNA
auuacuguacggcauacugg

SEQ ID NO: 133034 - RNA, 20 nt, Artificial Sequence
  mmSKRIPTE0003813_Ednra_6
  gRNA
ggagugcccauggacaaccg

SEQ ID NO: 133035 - RNA, 20 nt, Artificial Sequence
  mmSKRIPTE0003814_Ednra_7
  gRNA
ucucagagaagggaucaacu

SEQ ID NO: 133036 - RNA, 20 nt, Artificial Sequence
  mmSKRIPTE0003815_Ednra_8
  gRNA
uauucuaggagcaauaggcu

SEQ ID NO: 133037 - RNA, 20 nt, Artificial Sequence
  mmSKRIPTE0003816_Ednra_9
  gRNA
guugaccccccauuacagac

SEQ ID NO: 133038 - RNA, 20 nt, Artificial Sequence
  mmSKRIPTE0003817_Apoa1_1
  gRNA
guaaggaaagaccuagcgug

SEQ ID NO: 133039 - RNA, 20 nt, Artificial Sequence
  mmSKRIPTE0003818_Apoa1_2
  gRNA
uaggugccucuugaccugcg

SEQ ID NO: 133040 - RNA, 20 nt, Artificial Sequence
  mmSKRIPTE0003819_Apoa1_3
  gRNA
uuguaagaaagccaaugcgg

SEQ ID NO: 133041 - RNA, 20 nt, Artificial Sequence
  mmSKRIPTE0003820_Apoa1_4
  gRNA
gagaacauggugccgcacug

SEQ ID NO: 133042 - RNA, 20 nt, Artificial Sequence
  mmSKRIPTE0003821_Apoa1_5
  gRNA
cacuguccaaaucaauaccg

SEQ ID NO: 133043 - RNA, 20 nt, Artificial Sequence
  mmSKRIPTE0003822_Apoa1_6
  gRNA
agcugaguagucgcguacaa

SEQ ID NO: 133044 - RNA, 20 nt, Artificial Sequence
  mmSKRIPTE0003823_Apoa1_7
  gRNA
ucucgcgcaucuguucgcug

SEQ ID NO: 133045 - RNA, 20 nt, Artificial Sequence
  mmSKRIPTE0003824_Apoa1_8
  gRNA
acugucggagagcuccgggg

SEQ ID NO: 133046 - RNA, 20 nt, Artificial Sequence
  mmSKRIPTE0003825_Apoa1_9
  gRNA
uuagguuagacucggaguca

SEQ ID NO: 133047 - RNA, 20 nt, Artificial Sequence
  mmSKRIPTE0003826_Apoa4_1
  gRNA
gaaagcaugaccuaccccag

SEQ ID NO: 133048 - RNA, 20 nt, Artificial Sequence
  mmSKRIPTE0003827_Apoa4_2
  gRNA
ugcuaguacguaugcugaug

SEQ ID NO: 133049 - RNA, 20 nt, Artificial Sequence
  mmSKRIPTE0003828_Apoa4_3
  gRNA
uagaacuggcggacagcucg

SEQ ID NO: 133050 - RNA, 20 nt, Artificial Sequence
  mmSKRIPTE0003829_Apoa4_4
  gRNA
guaagugcgaucagucuaca

SEQ ID NO: 133051 - RNA, 20 nt, Artificial Sequence
  mmSKRIPTE0003830_Apoa4_5
  gRNA
uuaguggcccuaagacaacg

SEQ ID NO: 133052 - RNA, 20 nt, Artificial Sequence
  mmSKRIPTE0003831_Apoa4_6
  gRNA
gagugugucaccuuccaacg

SEQ ID NO: 133053 - RNA, 20 nt, Artificial Sequence
  mmSKRIPTE0003832_Apoa4_7
  gRNA
gacugguggcugucucacug

SEQ ID NO: 133054 - RNA, 20 nt, Artificial Sequence
  mmSKRIPTE0003833_Apoa4_8
  gRNA
cuuuauugaguagcgagaug

SEQ ID NO: 133055 - RNA, 20 nt, Artificial Sequence
  mmSKRIPTE0003834_Apoa4_9
  gRNA
caaaguaacccagacguucg

SEQ ID NO: 133056 - RNA, 20 nt, Artificial Sequence
  mmSKRIPTE0003835_Trf_1
  gRNA
acagcguaguaguaggucug

SEQ ID NO: 133057 - RNA, 20 nt, Artificial Sequence
  mmSKRIPTE0003836_Trf_2
  gRNA
ugcaaucugucgguaacaug

SEQ ID NO: 133058 - RNA, 20 nt, Artificial Sequence
  mmSKRIPTE0003837_Trf_3
  gRNA
ggaaucaacccaaaccggca

SEQ ID NO: 133059 - RNA, 20 nt, Artificial Sequence
  mmSKRIPTE0003838_Trf_4
  gRNA
acuguccuggauaacaccga

SEQ ID NO: 133060 - RNA, 20 nt, Artificial Sequence
  mmSKRIPTE0003839_Trf_5
  gRNA
ugaguggaauugacacucug

SEQ ID NO: 133061 - RNA, 20 nt, Artificial Sequence
  mmSKRIPTE0003840_Trf_6
  gRNA
uccgaacaaccugaagcccg

SEQ ID NO: 133062 - RNA, 20 nt, Artificial Sequence
  mmSKRIPTE0003841_Trf_7
  gRNA
gccaugugccuaagauggcg

SEQ ID NO: 133063 - RNA, 20 nt, Artificial Sequence
  mmSKRIPTE0003842_Trf_8
  gRNA
ccgcucgccuuuaugcacgg

SEQ ID NO: 133064 - RNA, 20 nt, Artificial Sequence
  mmSKRIPTE0003843_Trf_9
  gRNA
guggaaccguuguagucacu

SEQ ID NO: 133065 - RNA, 20 nt, Artificial Sequence
  mmSKRIPTE0003844_Madcam1_1
  gRNA
gcugccaauccauaggacga

SEQ ID NO: 133066 - RNA, 20 nt, Artificial Sequence
  mmSKRIPTE0003845_Madcam1_2
  gRNA
uuguuggggaucuacaggug

SEQ ID NO: 133067 - RNA, 20 nt, Artificial Sequence
  mmSKRIPTE0003846_Madcam1_3
  gRNA
acagcaugccccguacagag

SEQ ID NO: 133068 - RNA, 20 nt, Artificial Sequence
  mmSKRIPTE0003847_Madcam1_4
  gRNA
cguugugucauucggaacag

SEQ ID NO: 133069 - RNA, 20 nt, Artificial Sequence
  mmSKRIPTE0003848_Madcam1_5
  gRNA
guagcauuuccacaggcggu

SEQ ID NO: 133070 - RNA, 20 nt, Artificial Sequence
  mmSKRIPTE0003849_Madcam1_6
  gRNA
gcaagguccugauucccccg

SEQ ID NO: 133071 - RNA, 20 nt, Artificial Sequence
  mmSKRIPTE0003850_Madcam1_7
  gRNA
cggcuuaaauaagagugggc

SEQ ID NO: 133072 - RNA, 20 nt, Artificial Sequence
  mmSKRIPTE0003851_Madcam1_8
  gRNA
cagaccacgccagugcaccc

SEQ ID NO: 133073 - RNA, 20 nt, Artificial Sequence
  mmSKRIPTE0003852_Madcam1_9
  gRNA
aaggugccccgaguucuaag

SEQ ID NO: 133074 - RNA, 20 nt, Artificial Sequence
  mmSKRIPTE0003853_Ifng_1
  gRNA
cuccguaguaaguuggacag

SEQ ID NO: 133075 - RNA, 20 nt, Artificial Sequence
  mmSKRIPTE0003854_Ifng_2
  gRNA
ugugaaaauacguaaucccg

SEQ ID NO: 133076 - RNA, 20 nt, Artificial Sequence
  mmSKRIPTE0003855_Ifng_3
  gRNA
uagccaagacugugauugcg

SEQ ID NO: 133077 - RNA, 20 nt, Artificial Sequence
  mmSKRIPTE0003856_Ifng_4
  gRNA
ugcuugugguugguugaccg

SEQ ID NO: 133078 - RNA, 20 nt, Artificial Sequence
  mmSKRIPTE0003857_Ifng_5
  gRNA
gucuucucuaggucagccga

SEQ ID NO: 133079 - RNA, 20 nt, Artificial Sequence
  mmSKRIPTE0003858_Ifng_6
  gRNA
ccaccuagcgaugaauggga

SEQ ID NO: 133080 - RNA, 20 nt, Artificial Sequence
  mmSKRIPTE0003859_Ifng_7
  gRNA
aaggagucgcugcugauucg

SEQ ID NO: 133081 - RNA, 20 nt, Artificial Sequence
  mmSKRIPTE0003860_Ifng_8
  gRNA
gaaaagccccacacuuaacg

SEQ ID NO: 133082 - RNA, 20 nt, Artificial Sequence
  mmSKRIPTE0003861_Ifng_9
  gRNA
acucaucagcugauaaagcu

SEQ ID NO: 133083 - RNA, 20 nt, Artificial Sequence
  mmSKRIPTE0003862_Il13_1
  gRNA
agucugucaguaucccggug

SEQ ID NO: 133084 - RNA, 20 nt, Artificial Sequence
  mmSKRIPTE0003863_Il13_2
  gRNA
uuaccguagugggggccuug

SEQ ID NO: 133085 - RNA, 20 nt, Artificial Sequence
  mmSKRIPTE0003864_Il13_3
  gRNA
agaucuuggcaccggcccug

SEQ ID NO: 133086 - RNA, 20 nt, Artificial Sequence
  mmSKRIPTE0003865_Il13_4
  gRNA
gcauggccucuguaaccgca

SEQ ID NO: 133087 - RNA, 20 nt, Artificial Sequence
  mmSKRIPTE0003866_Il13_5
  gRNA
acaaagcaacuguuucgcca

SEQ ID NO: 133088 - RNA, 20 nt, Artificial Sequence
  mmSKRIPTE0003867_Il13_6
  gRNA
accaugcugccguugcacag

SEQ ID NO: 133089 - RNA, 20 nt, Artificial Sequence
  mmSKRIPTE0003868_Il13_7
  gRNA
ccaggcucuaugcuacccga

SEQ ID NO: 133090 - RNA, 20 nt, Artificial Sequence
  mmSKRIPTE0003869_Il13_8
  gRNA
gcgaagcauaggguguugag

SEQ ID NO: 133091 - RNA, 20 nt, Artificial Sequence
  mmSKRIPTE0003870_Il13_9
  gRNA
cacgcccccugucuacugug

SEQ ID NO: 133092 - RNA, 20 nt, Artificial Sequence
  mmSKRIPTE0003871_Auad5_1
  gRNA
uacaacaggaguugucgaga

SEQ ID NO: 133093 - RNA, 20 nt, Artificial Sequence
  mmSKRIPTE0003872_Auad5_2
  gRNA
ugauguaacaacuuuccccg

SEQ ID NO: 133094 - RNA, 20 nt, Artificial Sequence
  mmSKRIPTE0003873_Auad5_3
  gRNA
uccaaaaguaaugacgacgu

SEQ ID NO: 133095 - RNA, 20 nt, Artificial Sequence
  mmSKRIPTE0003874_Auad5_4
  gRNA
uaaugacggauucuaccaug

SEQ ID NO: 133096 - RNA, 20 nt, Artificial Sequence
  mmSKRIPTE0003875_Auad5_5
  gRNA
gucucguagagaccaccggc

SEQ ID NO: 133097 - RNA, 20 nt, Artificial Sequence
  mmSKRIPTE0003876_Auad5_6
  gRNA
gacaauacaaggugcccccg

SEQ ID NO: 133098 - RNA, 20 nt, Artificial Sequence
  mmSKRIPTE0003877_Auad5_7
  gRNA
gagcuuuacacggcacacug

SEQ ID NO: 133099 - RNA, 20 nt, Artificial Sequence
  mmSKRIPTE0003878_Auad5_8
  gRNA
ucugcggcugucgaguggaa

SEQ ID NO: 133100 - RNA, 20 nt, Artificial Sequence
  mmSKRIPTE0003879_Auad5_9
  gRNA
gcugucuuaggcguucccug

SEQ ID NO: 133101 - RNA, 20 nt, Artificial Sequence
  mmSKRIPTE0003880_Ccl3_1
  gRNA
aagugaagagucccucgaug

SEQ ID NO: 133102 - RNA, 20 nt, Artificial Sequence
  mmSKRIPTE0003881_Ccl3_2
  gRNA
ugauggauauuacacaaccc

SEQ ID NO: 133103 - RNA, 20 nt, Artificial Sequence
  mmSKRIPTE0003882_Ccl3_3
  gRNA
cagguggcaggaauguuccg

SEQ ID NO: 133104 - RNA, 20 nt, Artificial Sequence
  mmSKRIPTE0003883_Ccl3_4
  gRNA
agggcuaccuauaagagaag

SEQ ID NO: 133105 - RNA, 20 nt, Artificial Sequence
  mmSKRIPTE0003884_Ccl3_5
  gRNA
cuaaaacaacuuaagaggcg

SEQ ID NO: 133106 - RNA, 20 nt, Artificial Sequence
  mmSKRIPTE0003885_Ccl3_6
  gRNA
gcucuacacgggacccaugg

SEQ ID NO: 133107 - RNA, 20 nt, Artificial Sequence
  mmSKRIPTE0003886_Ccl3_7
  gRNA
gacccuuccacaccauagag

SEQ ID NO: 133108 - RNA, 20 nt, Artificial Sequence
  mmSKRIPTE0003887_Ccl3_8
  gRNA
aagucaucauugaacagggu

SEQ ID NO: 133109 - RNA, 20 nt, Artificial Sequence
  mmSKRIPTE0003888_Ccl3_9
  gRNA
ugagagucuuggaggcagcg

SEQ ID NO: 133110 - RNA, 20 nt, Artificial Sequence
  mmSKRIPTE0003889_Acug1_1
  gRNA
aaugacucgucacgcccaag

SEQ ID NO: 133111 - RNA, 20 nt, Artificial Sequence
  mmSKRIPTE0003890_Acug1_2
  gRNA
ccgacaccagguuaguugag

SEQ ID NO: 133112 - RNA, 20 nt, Artificial Sequence
  mmSKRIPTE0003891_Acug1_3
  gRNA
ucuuccugcgcagaucgcaa

SEQ ID NO: 133113 - RNA, 20 nt, Artificial Sequence
  mmSKRIPTE0003892_Acug1_4
  gRNA
uaaggccagcucaggccggg

SEQ ID NO: 133114 - RNA, 20 nt, Artificial Sequence
  mmSKRIPTE0003893_Acug1_5
  gRNA
uuggcuccuaaaucauguug

SEQ ID NO: 133115 - RNA, 20 nt, Artificial Sequence
  mmSKRIPTE0003894_Acug1_6
  gRNA
uaaggugaguggcuaccacc

SEQ ID NO: 133116 - RNA, 20 nt, Artificial Sequence
  mmSKRIPTE0003895_Acug1_7
  gRNA
cccugcgagagaaaaggccg

SEQ ID NO: 133117 - RNA, 20 nt, Artificial Sequence
  mmSKRIPTE0003896_Acug1_8
  gRNA
gcggcguaaccgucggcuac

SEQ ID NO: 133118 - RNA, 20 nt, Artificial Sequence
  mmSKRIPTE0003897_Acug1_9
  gRNA
gcggagugugagaccgaccg

SEQ ID NO: 133119 - RNA, 20 nt, Artificial Sequence
  mmSKRIPTE0003898_Cxcl14_1
  gRNA
uaaugagcucgcucuccgag

SEQ ID NO: 133120 - RNA, 20 nt, Artificial Sequence
  mmSKRIPTE0003899_Cxcl14_2
  gRNA
ucugagcuuuauaagcgccu

SEQ ID NO: 133121 - RNA, 20 nt, Artificial Sequence
  mmSKRIPTE0003900_Cxcl14_3
  gRNA
cucgauguucgggaggacaa

SEQ ID NO: 133122 - RNA, 20 nt, Artificial Sequence
  mmSKRIPTE0003901_Cxcl14_4
  gRNA
aagagcauguccagguaccg

SEQ ID NO: 133123 - RNA, 20 nt, Artificial Sequence
  mmSKRIPTE0003902_Cxcl14_5
  gRNA
cugccuuugacaagaccgac

SEQ ID NO: 133124 - RNA, 20 nt, Artificial Sequence
  mmSKRIPTE0003903_Cxcl14_6
  gRNA
ggggagcucccauugccaag

SEQ ID NO: 133125 - RNA, 20 nt, Artificial Sequence
  mmSKRIPTE0003904_Cxcl14_7
  gRNA
agggucuacgaagaauaggg

SEQ ID NO: 133126 - RNA, 20 nt, Artificial Sequence
  mmSKRIPTE0003905_Cxcl14_8
  gRNA
uaucaguccgaucuaacccu

SEQ ID NO: 133127 - RNA, 20 nt, Artificial Sequence
  mmSKRIPTE0003906_Cxcl14_9
  gRNA
ugggggucacacguuagaug

SEQ ID NO: 133128 - RNA, 20 nt, Artificial Sequence
  mmSKRIPTE0003907_Naip5_1
  gRNA
cggaugucaugggaaccgug

SEQ ID NO: 133129 - RNA, 20 nt, Artificial Sequence
  mmSKRIPTE0003908_Naip5_2
  gRNA
acccugauccaucuauccga

SEQ ID NO: 133130 - RNA, 20 nt, Artificial Sequence
  mmSKRIPTE0003909_Naip5_3
  gRNA
cuccgggucauaucucacgc

SEQ ID NO: 133131 - RNA, 20 nt, Artificial Sequence
  mmSKRIPTE0003910_Naip5_4
  gRNA
cacuggguggaggauauaca

SEQ ID NO: 133132 - RNA, 20 nt, Artificial Sequence
  mmSKRIPTE0003911_Naip5_5
  gRNA
cguauucauuagccuugaug

SEQ ID NO: 133133 - RNA, 20 nt, Artificial Sequence
  mmSKRIPTE0003912_Naip5_6
  gRNA
gaauuugcucaucaagaggg

SEQ ID NO: 133134 - RNA, 20 nt, Artificial Sequence
  mmSKRIPTE0003913_Naip5_7
  gRNA
uauguaaugacuuugugcac

SEQ ID NO: 133135 - RNA, 20 nt, Artificial Sequence
  mmSKRIPTE0003914_Naip5_8
  gRNA
acuagugaacagaugaccua

SEQ ID NO: 133136 - RNA, 20 nt, Artificial Sequence
  mmSKRIPTE0003915_Naip5_9
  gRNA
acuagagcuucaacacccac

SEQ ID NO: 133137 - RNA, 20 nt, Artificial Sequence
  mmSKRIPTE0003916_Angpt1_1
  gRNA
ucucaagcaugguggccgug

SEQ ID NO: 133138 - RNA, 20 nt, Artificial Sequence
  mmSKRIPTE0003917_Angpt1_2
  gRNA
caaggcaauugucugcggaa

SEQ ID NO: 133139 - RNA, 20 nt, Artificial Sequence
  mmSKRIPTE0003918_Angpt1_3
  gRNA
cggugccgauuucagcacga

SEQ ID NO: 133140 - RNA, 20 nt, Artificial Sequence
  mmSKRIPTE0003919_Angpt1_4
  gRNA
aaaaauguacguguaaccag

SEQ ID NO: 133141 - RNA, 20 nt, Artificial Sequence
  mmSKRIPTE0003920_Angpt1_5
  gRNA
auauguacucgcagcugacg

SEQ ID NO: 133142 - RNA, 20 nt, Artificial Sequence
  mmSKRIPTE0003921_Angpt1_6
  gRNA
cucuguguaaccguucagcg

SEQ ID NO: 133143 - RNA, 20 nt, Artificial Sequence
  mmSKRIPTE0003922_Angpt1_7
  gRNA
acugcucugucgcacucuca

SEQ ID NO: 133144 - RNA, 20 nt, Artificial Sequence
  mmSKRIPTE0003923_Angpt1_8
  gRNA
uucaaacgcuuucuuuaacg

SEQ ID NO: 133145 - RNA, 20 nt, Artificial Sequence
  mmSKRIPTE0003924_Angpt1_9
  gRNA
gcaugaccucgaucauguau

SEQ ID NO: 133146 - RNA, 20 nt, Artificial Sequence
  mmSKRIPTE0003925_Rubcn_1
  gRNA
gugcaguauagccugacuag

SEQ ID NO: 133147 - RNA, 20 nt, Artificial Sequence
  mmSKRIPTE0003926_Rubcn_2
  gRNA
auaaagaggcgaguacucgg

SEQ ID NO: 133148 - RNA, 20 nt, Artificial Sequence
  mmSKRIPTE0003927_Rubcn_3
  gRNA
cggacuauaaggccgucucg

SEQ ID NO: 133149 - RNA, 20 nt, Artificial Sequence
  mmSKRIPTE0003928_Rubcn_4
  gRNA
ggaugccacaucccgcacag

SEQ ID NO: 133150 - RNA, 20 nt, Artificial Sequence
  mmSKRIPTE0003929_Rubcn_5
  gRNA
uccuaguagaagaggccgag

SEQ ID NO: 133151 - RNA, 20 nt, Artificial Sequence
  mmSKRIPTE0003930_Rubcn_6
  gRNA
ggguaauuugaagacgacug

SEQ ID NO: 133152 - RNA, 20 nt, Artificial Sequence
  mmSKRIPTE0003931_Rubcn_7
  gRNA
uagcagucacccacucagcg

SEQ ID NO: 133153 - RNA, 20 nt, Artificial Sequence
  mmSKRIPTE0003932_Rubcn_8
  gRNA
accgugucacuaauucagcc

SEQ ID NO: 133154 - RNA, 20 nt, Artificial Sequence
  mmSKRIPTE0003933_Rubcn_9
  gRNA
gcauggaauguagcaccuag

SEQ ID NO: 133155 - RNA, 20 nt, Artificial Sequence
  mmSKRIPTE0003934_Axin1_1
  gRNA
cagcccauauccacauagcg

SEQ ID NO: 133156 - RNA, 20 nt, Artificial Sequence
  mmSKRIPTE0003935_Axin1_2
  gRNA
agcacgugcaaagggucaug

SEQ ID NO: 133157 - RNA, 20 nt, Artificial Sequence
  mmSKRIPTE0003936_Axin1_3
  gRNA
gggaacaacccgcaucaaag

SEQ ID NO: 133158 - RNA, 20 nt, Artificial Sequence
  mmSKRIPTE0003937_Axin1_4
  gRNA
guuguaccgucuacuugagg

SEQ ID NO: 133159 - RNA, 20 nt, Artificial Sequence
  mmSKRIPTE0003938_Axin1_5
  gRNA
cuucggugaaacuugcuccg

SEQ ID NO: 133160 - RNA, 20 nt, Artificial Sequence
  mmSKRIPTE0003939_Axin1_6
  gRNA
ggcauucgguaagugcgcug

SEQ ID NO: 133161 - RNA, 20 nt, Artificial Sequence
  mmSKRIPTE0003940_Axin1_7
  gRNA
ucccacuacucaccagcgcg

SEQ ID NO: 133162 - RNA, 20 nt, Artificial Sequence
  mmSKRIPTE0003941_Axin1_8
  gRNA
ggcacaaccucgcacaucag

SEQ ID NO: 133163 - RNA, 20 nt, Artificial Sequence
  mmSKRIPTE0003942_Axin1_9
  gRNA
ugaagaaaagaucaucggca

SEQ ID NO: 133164 - RNA, 20 nt, Artificial Sequence
  mmSKRIPTE0003943_Prkcq_1
  gRNA
agagcccuuugucgccaaca

SEQ ID NO: 133165 - RNA, 20 nt, Artificial Sequence
  mmSKRIPTE0003944_Prkcq_2
  gRNA
aucccaaguaggcacuuacg

SEQ ID NO: 133166 - RNA, 20 nt, Artificial Sequence
  mmSKRIPTE0003945_Prkcq_3
  gRNA
ggguaaggaugucgccuacg

SEQ ID NO: 133167 - RNA, 20 nt, Artificial Sequence
  mmSKRIPTE0003946_Prkcq_4
  gRNA
caccaugcguaccaacaccu

SEQ ID NO: 133168 - RNA, 20 nt, Artificial Sequence
  mmSKRIPTE0003947_Prkcq_5
  gRNA
gacagccaagacacggcacg

SEQ ID NO: 133169 - RNA, 20 nt, Artificial Sequence
  mmSKRIPTE0003948_Prkcq_6
  gRNA
ugcugguuggugaugaacca

SEQ ID NO: 133170 - RNA, 20 nt, Artificial Sequence
  mmSKRIPTE0003949_Prkcq_7
  gRNA
agggaguauaaaugacgcgu

SEQ ID NO: 133171 - RNA, 20 nt, Artificial Sequence
  mmSKRIPTE0003950_Prkcq_8
  gRNA
gcuccaccaaaaacgaaacc

SEQ ID NO: 133172 - RNA, 20 nt, Artificial Sequence
  mmSKRIPTE0003951_Prkcq_9
  gRNA
uagaguuuccagucucacgg

SEQ ID NO: 133173 - RNA, 20 nt, Artificial Sequence
  mmSKRIPTE0003952_Prnp_1
  gRNA
uuggacugguaccacuagga

SEQ ID NO: 133174 - RNA, 20 nt, Artificial Sequence
  mmSKRIPTE0003953_Prnp_2
  gRNA
gauagcuucagcuugcacug

SEQ ID NO: 133175 - RNA, 20 nt, Artificial Sequence
  mmSKRIPTE0003954_Prnp_3
  gRNA
agucccaggccuauuacgac

SEQ ID NO: 133176 - RNA, 20 nt, Artificial Sequence
  mmSKRIPTE0003955_Prnp_4
  gRNA
ccuagaccacgagaaugcga

SEQ ID NO: 133177 - RNA, 20 nt, Artificial Sequence
  mmSKRIPTE0003956_Prnp_5
  gRNA
ggucugcugauccgacaacg

SEQ ID NO: 133178 - RNA, 20 nt, Artificial Sequence
  mmSKRIPTE0003957_Prnp_6
  gRNA
gcauuuaagccaguccggag

SEQ ID NO: 133179 - RNA, 20 nt, Artificial Sequence
  mmSKRIPTE0003958_Prnp_7
  gRNA
cagugagccgagcuugacga

SEQ ID NO: 133180 - RNA, 20 nt, Artificial Sequence
  mmSKRIPTE0003959_Prnp_8
  gRNA
auaguugcugagcgucguca

SEQ ID NO: 133181 - RNA, 20 nt, Artificial Sequence
  mmSKRIPTE0003960_Prnp_9
  gRNA
gccacccuggcgauaaacag

SEQ ID NO: 133182 - RNA, 20 nt, Artificial Sequence
  mmSKRIPTE0003961_Gbp5_1
  gRNA
ggguggaguucccuaguccg

SEQ ID NO: 133183 - RNA, 20 nt, Artificial Sequence
  mmSKRIPTE0003962_Gbp5_2
  gRNA
gugccucauugggagcaccg

SEQ ID NO: 133184 - RNA, 20 nt, Artificial Sequence
  mmSKRIPTE0003963_Gbp5_3
  gRNA
cuuaaucacauagcuccucg

SEQ ID NO: 133185 - RNA, 20 nt, Artificial Sequence
  mmSKRIPTE0003964_Gbp5_4
  gRNA
uaguaucguucccaugcaug

SEQ ID NO: 133186 - RNA, 20 nt, Artificial Sequence
  mmSKRIPTE0003965_Gbp5_5
  gRNA
agauacacuggcuuccgcug

SEQ ID NO: 133187 - RNA, 20 nt, Artificial Sequence
  mmSKRIPTE0003966_Gbp5_6
  gRNA
uguauacaaaggugcuacug

SEQ ID NO: 133188 - RNA, 20 nt, Artificial Sequence
  mmSKRIPTE0003967_Gbp5_7
  gRNA
gaaagcuuacuuccaagcgc

SEQ ID NO: 133189 - RNA, 20 nt, Artificial Sequence
  mmSKRIPTE0003968_Gbp5_8
  gRNA
uuaaacuugauguaccucug

SEQ ID NO: 133190 - RNA, 20 nt, Artificial Sequence
  mmSKRIPTE0003969_Gbp5_9
  gRNA
uaucuauccagaaggcaaug

SEQ ID NO: 133191 - RNA, 20 nt, Artificial Sequence
  mmSKRIPTE0003970_Trim14_1
  gRNA
uaacucauccagaugcggcg

SEQ ID NO: 133192 - RNA, 20 nt, Artificial Sequence
  mmSKRIPTE0003971_Trim14_2
  gRNA
ugguaauaaaguuuacccga

SEQ ID NO: 133193 - RNA, 20 nt, Artificial Sequence
  mmSKRIPTE0003972_Trim14_3
  gRNA
uuugccgcagugguaaaugg

SEQ ID NO: 133194 - RNA, 20 nt, Artificial Sequence
  mmSKRIPTE0003973_Trim14_4
  gRNA
aauggcgagcgagacuaccg

SEQ ID NO: 133195 - RNA, 20 nt, Artificial Sequence
  mmSKRIPTE0003974_Trim14_5
  gRNA
auguacuacauaucauacua

SEQ ID NO: 133196 - RNA, 20 nt, Artificial Sequence
  mmSKRIPTE0003975_Trim14_6
  gRNA
agaaaucgaaaccuugcucg

SEQ ID NO: 133197 - RNA, 20 nt, Artificial Sequence
  mmSKRIPTE0003976_Trim14_7
  gRNA
uagacucaaaacaagcuggu

SEQ ID NO: 133198 - RNA, 20 nt, Artificial Sequence
  mmSKRIPTE0003977_Trim14_8
  gRNA
ggucaaaucccguuaggaca

SEQ ID NO: 133199 - RNA, 20 nt, Artificial Sequence
  mmSKRIPTE0003978_Trim14_9
  gRNA
aacaccgucuuuacacacca

SEQ ID NO: 133200 - RNA, 20 nt, Artificial Sequence
  mmSKRIPTE0003979_Tal1_1
  gRNA
ccuaaagugagaacuacccg

SEQ ID NO: 133201 - RNA, 20 nt, Artificial Sequence
  mmSKRIPTE0003980_Tal1_2
  gRNA
cugcacccagaacgccgcag

SEQ ID NO: 133202 - RNA, 20 nt, Artificial Sequence
  mmSKRIPTE0003981_Tal1_3
  gRNA
gcggcccuuuaagucccucg

SEQ ID NO: 133203 - RNA, 20 nt, Artificial Sequence
  mmSKRIPTE0003982_Tal1_4
  gRNA
caguuacuuagcuugccgug

SEQ ID NO: 133204 - RNA, 20 nt, Artificial Sequence
  mmSKRIPTE0003983_Tal1_5
  gRNA
caccugccuagugaggcgag

SEQ ID NO: 133205 - RNA, 20 nt, Artificial Sequence
  mmSKRIPTE0003984_Tal1_6
  gRNA
cagccccagacgcaucaccg

SEQ ID NO: 133206 - RNA, 20 nt, Artificial Sequence
  mmSKRIPTE0003985_Tal1_7
  gRNA
gguuggggugugcguccacg

SEQ ID NO: 133207 - RNA, 20 nt, Artificial Sequence
  mmSKRIPTE0003986_Tal1_8
  gRNA
uaaggcuauagagcagcgcu

SEQ ID NO: 133208 - RNA, 20 nt, Artificial Sequence
  mmSKRIPTE0003987_Tal1_9
  gRNA
gcaagcuggauggaucaaca

SEQ ID NO: 133209 - RNA, 20 nt, Artificial Sequence
  mmSKRIPTE0003988_Gfi1_1
  gRNA
ccuuccaccugguauacccg

SEQ ID NO: 133210 - RNA, 20 nt, Artificial Sequence
  mmSKRIPTE0003989_Gfi1_2
  gRNA
ggguccaaacauucguccag

SEQ ID NO: 133211 - RNA, 20 nt, Artificial Sequence
  mmSKRIPTE0003990_Gfi1_3
  gRNA
gcuguguaacacuaccguga

SEQ ID NO: 133212 - RNA, 20 nt, Artificial Sequence
  mmSKRIPTE0003991_Gfi1_4
  gRNA
acgugcaccuccagcccgug

SEQ ID NO: 133213 - RNA, 20 nt, Artificial Sequence
  mmSKRIPTE0003992_Gfi1_5
  gRNA
uggcuaagacuuucacgcug

SEQ ID NO: 133214 - RNA, 20 nt, Artificial Sequence
  mmSKRIPTE0003993_Gfi1_6
  gRNA
cgcccacuggaauaguggug

SEQ ID NO: 133215 - RNA, 20 nt, Artificial Sequence
  mmSKRIPTE0003994_Gfi1_7
  gRNA
cgagugccaccuggugagcg

SEQ ID NO: 133216 - RNA, 20 nt, Artificial Sequence
  mmSKRIPTE0003995_Gfi1_8
  gRNA
aggccauugagucaaguucg

SEQ ID NO: 133217 - RNA, 20 nt, Artificial Sequence
  mmSKRIPTE0003996_Gfi1_9
  gRNA
gcggcaucaagcccucccag

SEQ ID NO: 133218 - RNA, 20 nt, Artificial Sequence
  mmSKRIPTE0003997_Etv6_1
  gRNA
guccucacuagcaaacgcag

SEQ ID NO: 133219 - RNA, 20 nt, Artificial Sequence
  mmSKRIPTE0003998_Etv6_2
  gRNA
uuacucgugacaauggcggc

SEQ ID NO: 133220 - RNA, 20 nt, Artificial Sequence
  mmSKRIPTE0003999_Etv6_3
  gRNA
gcacucguguggcuucgaga

SEQ ID NO: 133221 - RNA, 20 nt, Artificial Sequence
  mmSKRIPTE0004000_Etv6_4
  gRNA
gugaacaugaagcggagucg

SEQ ID NO: 133222 - RNA, 20 nt, Artificial Sequence
  mmSKRIPTE0004001_Etv6_5
  gRNA
caaaggcguccuccgccucg

SEQ ID NO: 133223 - RNA, 20 nt, Artificial Sequence
  mmSKRIPTE0004002_Etv6_6
  gRNA
ucuagcauuaagguaacgau

SEQ ID NO: 133224 - RNA, 20 nt, Artificial Sequence
  mmSKRIPTE0004003_Etv6_7
  gRNA
cauacaauggaaccgcacac

SEQ ID NO: 133225 - RNA, 20 nt, Artificial Sequence
  mmSKRIPTE0004004_Etv6_8
  gRNA
uauguaaagaucucggcuag

SEQ ID NO: 133226 - RNA, 20 nt, Artificial Sequence
  mmSKRIPTE0004005_Etv6_9
  gRNA
cugcaucagaaccaugacga

SEQ ID NO: 133227 - RNA, 20 nt, Artificial Sequence
  mmSKRIPTE0004006_Cruc3_1
  gRNA
cguuggguaaggaucccccg

SEQ ID NO: 133228 - RNA, 20 nt, Artificial Sequence
  mmSKRIPTE0004007_Cruc3_2
  gRNA
aagucuguuauagcucacca

SEQ ID NO: 133229 - RNA, 20 nt, Artificial Sequence
  mmSKRIPTE0004008_Cruc3_3
  gRNA
ucggugacgcccacacaccg

SEQ ID NO: 133230 - RNA, 20 nt, Artificial Sequence
  mmSKRIPTE0004009_Cruc3_4
  gRNA
uagaccgguaggcucucuag

SEQ ID NO: 133231 - RNA, 20 nt, Artificial Sequence
  mmSKRIPTE0004010_Cruc3_5
  gRNA
ugauuuaaccugccgcacag

SEQ ID NO: 133232 - RNA, 20 nt, Artificial Sequence
  mmSKRIPTE0004011_Cruc3_6
  gRNA
aacugguagacauucuagag

SEQ ID NO: 133233 - RNA, 20 nt, Artificial Sequence
  mmSKRIPTE0004012_Cruc3_7
  gRNA
cugggacucguauuagugca

SEQ ID NO: 133234 - RNA, 20 nt, Artificial Sequence
  mmSKRIPTE0004013_Cruc3_8
  gRNA
ucacaggaagaugagcgcua

SEQ ID NO: 133235 - RNA, 20 nt, Artificial Sequence
  mmSKRIPTE0004014_Cruc3_9
  gRNA
acagaucacggugacccgug

SEQ ID NO: 133236 - RNA, 20 nt, Artificial Sequence
  mmSKRIPTE0004015_Il12rb1_1
  gRNA
gaucuguccuggucuagacg

SEQ ID NO: 133237 - RNA, 20 nt, Artificial Sequence
  mmSKRIPTE0004016_Il12rb1_2
  gRNA
acaauguuucucacguccug

SEQ ID NO: 133238 - RNA, 20 nt, Artificial Sequence
  mmSKRIPTE0004017_Il12rb1_3
  gRNA
cgguacuccacgacacgugu

SEQ ID NO: 133239 - RNA, 20 nt, Artificial Sequence
  mmSKRIPTE0004018_Il12rb1_4
  gRNA
gcgcagccgaguaauguaca

SEQ ID NO: 133240 - RNA, 20 nt, Artificial Sequence
  mmSKRIPTE0004019_Il12rb1_5
  gRNA
ugcacuacaaacccaccuug

SEQ ID NO: 133241 - RNA, 20 nt, Artificial Sequence
  mmSKRIPTE0004020_Il12rb1_6
  gRNA
gaggggcuaaguaaagugcg

SEQ ID NO: 133242 - RNA, 20 nt, Artificial Sequence
  mmSKRIPTE0004021_Il12rb1_7
  gRNA
uggaggcgaacacugugaug

SEQ ID NO: 133243 - RNA, 20 nt, Artificial Sequence
  mmSKRIPTE0004022_Il12rb1_8
  gRNA
guacagauaguugaggcgag

SEQ ID NO: 133244 - RNA, 20 nt, Artificial Sequence
  mmSKRIPTE0004023_Il12rb1_9
  gRNA
ggacugcaaagcgaguccga

SEQ ID NO: 133245 - RNA, 20 nt, Artificial Sequence
  mmSKRIPTE0004024_Calr_1
  gRNA
ccggaauacccuagaccuag

SEQ ID NO: 133246 - RNA, 20 nt, Artificial Sequence
  mmSKRIPTE0004025_Calr_2
  gRNA
cugaaacgauuaccauucug

SEQ ID NO: 133247 - RNA, 20 nt, Artificial Sequence
  mmSKRIPTE0004026_Calr_3
  gRNA
uuguagcuccugacagacgu

SEQ ID NO: 133248 - RNA, 20 nt, Artificial Sequence
  mmSKRIPTE0004027_Calr_4
  gRNA
ggcauagagucagauuagcg

SEQ ID NO: 133249 - RNA, 20 nt, Artificial Sequence
  mmSKRIPTE0004028_Calr_5
  gRNA
gggucgaccacgcguugugg

SEQ ID NO: 133250 - RNA, 20 nt, Artificial Sequence
  mmSKRIPTE0004029_Calr_6
  gRNA
uaaaccagucaaaaggaccg

SEQ ID NO: 133251 - RNA, 20 nt, Artificial Sequence
  mmSKRIPTE0004030_Calr_7
  gRNA
acgaggcagccgaggucucg

SEQ ID NO: 133252 - RNA, 20 nt, Artificial Sequence
  mmSKRIPTE0004031_Calr_8
  gRNA
uacgugaagcuguuuccgag

SEQ ID NO: 133253 - RNA, 20 nt, Artificial Sequence
  mmSKRIPTE0004032_Calr_9
  gRNA
cguucagagggccaacacug

SEQ ID NO: 133254 - RNA, 20 nt, Artificial Sequence
  mmSKRIPTE0004033_Rab4a_1
  gRNA
accaaguagccugagcgacg

SEQ ID NO: 133255 - RNA, 20 nt, Artificial Sequence
  mmSKRIPTE0004034_Rab4a_2
  gRNA
gugacgagaagcuacuacag

SEQ ID NO: 133256 - RNA, 20 nt, Artificial Sequence
  mmSKRIPTE0004035_Rab4a_3
  gRNA
gagacuuacgguaagacgcg

SEQ ID NO: 133257 - RNA, 20 nt, Artificial Sequence
  mmSKRIPTE0004036_Rab4a_4
  gRNA
gacuggcgagaacgucgaag

SEQ ID NO: 133258 - RNA, 20 nt, Artificial Sequence
  mmSKRIPTE0004037_Rab4a_5
  gRNA
gagauauccugcaaaccucg

SEQ ID NO: 133259 - RNA, 20 nt, Artificial Sequence
  mmSKRIPTE0004038_Rab4a_6
  gRNA
guuaggucgagugcacuccg

SEQ ID NO: 133260 - RNA, 20 nt, Artificial Sequence
  mmSKRIPTE0004039_Rab4a_7
  gRNA
gagcagcucuuuaggucacg

SEQ ID NO: 133261 - RNA, 20 nt, Artificial Sequence
  mmSKRIPTE0004040_Rab4a_8
  gRNA
auggcuacagcacgaccacu

SEQ ID NO: 133262 - RNA, 20 nt, Artificial Sequence
  mmSKRIPTE0004041_Rab4a_9
  gRNA
ggaaagcagaacuuuccgag

SEQ ID NO: 133263 - RNA, 20 nt, Artificial Sequence
  mmSKRIPTE0004042_5730559C18Rik_1
  gRNA
agucuuguucuaauacgcag

SEQ ID NO: 133264 - RNA, 20 nt, Artificial Sequence
  mmSKRIPTE0004043_5730559C18Rik_2
  gRNA
accagucgcugguaacgcag

SEQ ID NO: 133265 - RNA, 20 nt, Artificial Sequence
  mmSKRIPTE0004044_5730559C18Rik_3
  gRNA
ccccguugggaaguauccag

SEQ ID NO: 133266 - RNA, 20 nt, Artificial Sequence
  mmSKRIPTE0004045_5730559C18Rik_4
  gRNA
uuucuguccucuaagcgccg

SEQ ID NO: 133267 - RNA, 20 nt, Artificial Sequence
  mmSKRIPTE0004046_5730559C18Rik_5
  gRNA
aggggacggcuagcagcgug

SEQ ID NO: 133268 - RNA, 20 nt, Artificial Sequence
  mmSKRIPTE0004047_5730559C18Rik_6
  gRNA
ucauuccggagacccaagcg

SEQ ID NO: 133269 - RNA, 20 nt, Artificial Sequence
  mmSKRIPTE0004048_5730559C18Rik_7
  gRNA
ccacucgcucgaccgccaag

SEQ ID NO: 133270 - RNA, 20 nt, Artificial Sequence
  mmSKRIPTE0004049_5730559C18Rik_8
  gRNA
ucuuaccuauguacccgaca

SEQ ID NO: 133271 - RNA, 20 nt, Artificial Sequence
  mmSKRIPTE0004050_5730559C18Rik_9
  gRNA
ccuccggaguacguacacgg

SEQ ID NO: 133272 - RNA, 20 nt, Artificial Sequence
  mmSKRIPTE0004051_Il12b_1
  gRNA
aagcaccaaauuacuccgga

SEQ ID NO: 133273 - RNA, 20 nt, Artificial Sequence
  mmSKRIPTE0004052_Il12b_2
  gRNA
cgguagaugucuucucuacg

SEQ ID NO: 133274 - RNA, 20 nt, Artificial Sequence
  mmSKRIPTE0004053_Il12b_3
  gRNA
cucuucaaucagggcugcgu

SEQ ID NO: 133275 - RNA, 20 nt, Artificial Sequence
  mmSKRIPTE0004054_Il12b_4
  gRNA
auaauggugacuuccucgag

SEQ ID NO: 133276 - RNA, 20 nt, Artificial Sequence
  mmSKRIPTE0004055_Il12b_5
  gRNA
ugugagcuaugacguuccaa

SEQ ID NO: 133277 - RNA, 20 nt, Artificial Sequence
  mmSKRIPTE0004056_Il12b_6
  gRNA
ccgauccuaggaugcaacgu

SEQ ID NO: 133278 - RNA, 20 nt, Artificial Sequence
  mmSKRIPTE0004057_Il12b_7
  gRNA
ugagugcaucuaucauacag

SEQ ID NO: 133279 - RNA, 20 nt, Artificial Sequence
  mmSKRIPTE0004058_Il12b_8
  gRNA
cuggccauuacaugguacaa

SEQ ID NO: 133280 - RNA, 20 nt, Artificial Sequence
  mmSKRIPTE0004059_Il12b_9
  gRNA
uggagacaccagcaaaacga

SEQ ID NO: 133281 - RNA, 20 nt, Artificial Sequence
  mmSKRIPTE0004060_Tnk1_1
  gRNA
gccccagagagccuacgcca

SEQ ID NO: 133282 - RNA, 20 nt, Artificial Sequence
  mmSKRIPTE0004061_Tnk1_2
  gRNA
ucaugacagauacuucccgc

SEQ ID NO: 133283 - RNA, 20 nt, Artificial Sequence
  mmSKRIPTE0004062_Tnk1_3
  gRNA
gugccugggaggguuaauca

SEQ ID NO: 133284 - RNA, 20 nt, Artificial Sequence
  mmSKRIPTE0004063_Tnk1_4
  gRNA
ggguuauggacacuacccag

SEQ ID NO: 133285 - RNA, 20 nt, Artificial Sequence
  mmSKRIPTE0004064_Tnk1_5
  gRNA
cgcccccucaccaggcauag

SEQ ID NO: 133286 - RNA, 20 nt, Artificial Sequence
  mmSKRIPTE0004065_Tnk1_6
  gRNA
uugaggaacucaacgucacu

SEQ ID NO: 133287 - RNA, 20 nt, Artificial Sequence
  mmSKRIPTE0004066_Tnk1_7
  gRNA
aaggauaaaaugagugaccg

SEQ ID NO: 133288 - RNA, 20 nt, Artificial Sequence
  mmSKRIPTE0004067_Tnk1_8
  gRNA
ggacugguucggccacuggg

SEQ ID NO: 133289 - RNA, 20 nt, Artificial Sequence
  mmSKRIPTE0004068_Tnk1_9
  gRNA
augugaacaggacuucguca

SEQ ID NO: 133290 - RNA, 20 nt, Artificial Sequence
  mmSKRIPTE0004069_Crk_1
  gRNA
agggcgcgucauuuccggug

SEQ ID NO: 133291 - RNA, 20 nt, Artificial Sequence
  mmSKRIPTE0004070_Crk_2
  gRNA
uauaccgaacagcacuugug

SEQ ID NO: 133292 - RNA, 20 nt, Artificial Sequence
  mmSKRIPTE0004071_Crk_3
  gRNA
gcaacuucgacucggaggag

SEQ ID NO: 133293 - RNA, 20 nt, Artificial Sequence
  mmSKRIPTE0004072_Crk_4
  gRNA
cgcuaagcacauaguccccg

SEQ ID NO: 133294 - RNA, 20 nt, Artificial Sequence
  mmSKRIPTE0004073_Crk_5
  gRNA
agcugguucccaccgaugag

SEQ ID NO: 133295 - RNA, 20 nt, Artificial Sequence
  mmSKRIPTE0004074_Crk_6
  gRNA
gucuauacuucuccacguaa

SEQ ID NO: 133296 - RNA, 20 nt, Artificial Sequence
  mmSKRIPTE0004075_Crk_7
  gRNA
gacucgcuucuggauaaccc

SEQ ID NO: 133297 - RNA, 20 nt, Artificial Sequence
  mmSKRIPTE0004076_Crk_8
  gRNA
gggagcggaguguugacgcu

SEQ ID NO: 133298 - RNA, 20 nt, Artificial Sequence
  mmSKRIPTE0004077_Crk_9
  gRNA
uggggcccucagugcgcaug

SEQ ID NO: 133299 - RNA, 20 nt, Artificial Sequence
  mmSKRIPTE0004078_Prkca_1
  gRNA
ucauucucugaagugccgga

SEQ ID NO: 133300 - RNA, 20 nt, Artificial Sequence
  mmSKRIPTE0004079_Prkca_2
  gRNA
gaaccgaugaucgaauggga

SEQ ID NO: 133301 - RNA, 20 nt, Artificial Sequence
  mmSKRIPTE0004080_Prkca_3
  gRNA
cuaacaacacucgugaacag

SEQ ID NO: 133302 - RNA, 20 nt, Artificial Sequence
  mmSKRIPTE0004081_Prkca_4
  gRNA
aagcaaaucaagucaugucg

SEQ ID NO: 133303 - RNA, 20 nt, Artificial Sequence
  mmSKRIPTE0004082_Prkca_5
  gRNA
cauguuucccuacacgccgc

SEQ ID NO: 133304 - RNA, 20 nt, Artificial Sequence
  mmSKRIPTE0004083_Prkca_6
  gRNA
cuguggauguggcgaccacc

SEQ ID NO: 133305 - RNA, 20 nt, Artificial Sequence
  mmSKRIPTE0004084_Prkca_7
  gRNA
gguuagcuccgugaacacgg

SEQ ID NO: 133306 - RNA, 20 nt, Artificial Sequence
  mmSKRIPTE0004085_Prkca_8
  gRNA
cugugaaaaucgcugcacag

SEQ ID NO: 133307 - RNA, 20 nt, Artificial Sequence
  mmSKRIPTE0004086_Prkca_9
  gRNA
cggcaccgccaucuacucgg

SEQ ID NO: 133308 - RNA, 20 nt, Artificial Sequence
  mmSKRIPTE0004087_Akt1_1
  gRNA
aggucacggggauacucgca

SEQ ID NO: 133309 - RNA, 20 nt, Artificial Sequence
  mmSKRIPTE0004088_Akt1_2
  gRNA
agcucuucaauguggaaccg

SEQ ID NO: 133310 - RNA, 20 nt, Artificial Sequence
  mmSKRIPTE0004089_Akt1_3
  gRNA
acucugucagcguugugucg

SEQ ID NO: 133311 - RNA, 20 nt, Artificial Sequence
  mmSKRIPTE0004090_Akt1_4
  gRNA
cacgccgccugaucaaggug

SEQ ID NO: 133312 - RNA, 20 nt, Artificial Sequence
  mmSKRIPTE0004091_Akt1_5
  gRNA
gaacgacguagccauuguga

SEQ ID NO: 133313 - RNA, 20 nt, Artificial Sequence
  mmSKRIPTE0004092_Akt1_6
  gRNA
acugcccacugagaaacccg

SEQ ID NO: 133314 - RNA, 20 nt, Artificial Sequence
  mmSKRIPTE0004093_Akt1_7
  gRNA
uucuugaggaggaaguagcg

SEQ ID NO: 133315 - RNA, 20 nt, Artificial Sequence
  mmSKRIPTE0004094_Akt1_8
  gRNA
agugucuuagccaugcgggu

SEQ ID NO: 133316 - RNA, 20 nt, Artificial Sequence
  mmSKRIPTE0004095_Akt1_9
  gRNA
uguaccuucuagauaacacg

SEQ ID NO: 133317 - RNA, 20 nt, Artificial Sequence
  mmSKRIPTE0004096_Inhba_1
  gRNA
cugcugcugaaauagacgga

SEQ ID NO: 133318 - RNA, 20 nt, Artificial Sequence
  mmSKRIPTE0004097_Inhba_2
  gRNA
guuagguccauccuucggaa

SEQ ID NO: 133319 - RNA, 20 nt, Artificial Sequence
  mmSKRIPTE0004098_Inhba_3
  gRNA
ccucaucgcaggcguaggcg

SEQ ID NO: 133320 - RNA, 20 nt, Artificial Sequence
  mmSKRIPTE0004099_Inhba_4
  gRNA
uccuggcagcaaaagucgug

SEQ ID NO: 133321 - RNA, 20 nt, Artificial Sequence
  mmSKRIPTE0004100_Inhba_5
  gRNA
ucaccuuugccgagucaggu

SEQ ID NO: 133322 - RNA, 20 nt, Artificial Sequence
  mmSKRIPTE0004101_Inhba_6
  gRNA
cuaauaacuaauaaccuccc

SEQ ID NO: 133323 - RNA, 20 nt, Artificial Sequence
  mmSKRIPTE0004102_Inhba_7
  gRNA
cuaucacgccaauuauugug

SEQ ID NO: 133324 - RNA, 20 nt, Artificial Sequence
  mmSKRIPTE0004103_Inhba_8
  gRNA
caaaaaaaccugugcgugag

SEQ ID NO: 133325 - RNA, 20 nt, Artificial Sequence
  mmSKRIPTE0004104_Inhba_9
  gRNA
aagcagauuuauuucaugcg

SEQ ID NO: 133326 - RNA, 20 nt, Artificial Sequence
  mmSKRIPTE0004105_Wrnip1_1
  gRNA
acuucccgacacgacucgcg

SEQ ID NO: 133327 - RNA, 20 nt, Artificial Sequence
  mmSKRIPTE0004106_Wrnip1_2
  gRNA
aauagauaggcaacuuacgu

SEQ ID NO: 133328 - RNA, 20 nt, Artificial Sequence
  mmSKRIPTE0004107_Wrnip1_3
  gRNA
cgccucguucggagucagcg

SEQ ID NO: 133329 - RNA, 20 nt, Artificial Sequence
  mmSKRIPTE0004108_Wrnip1_4
  gRNA
ucaaugcgagaaauugccgg

SEQ ID NO: 133330 - RNA, 20 nt, Artificial Sequence
  mmSKRIPTE0004109_Wrnip1_5
  gRNA
ccuuaucccggacuucccgg

SEQ ID NO: 133331 - RNA, 20 nt, Artificial Sequence
  mmSKRIPTE0004110_Wrnip1_6
  gRNA
ccagcgaggacaucggugag

SEQ ID NO: 133332 - RNA, 20 nt, Artificial Sequence
  mmSKRIPTE0004111_Wrnip1_7
  gRNA
cccggcucagaauaccuccg

SEQ ID NO: 133333 - RNA, 20 nt, Artificial Sequence
  mmSKRIPTE0004112_Wrnip1_8
  gRNA
caggugcgaauugaugugcg

SEQ ID NO: 133334 - RNA, 20 nt, Artificial Sequence
  mmSKRIPTE0004113_Wrnip1_9
  gRNA
caagaacaauuacccgacag

SEQ ID NO: 133335 - RNA, 20 nt, Artificial Sequence
  mmSKRIPTE0004114_Nuggc_1
  gRNA
uccaucugaaggaccgagug

SEQ ID NO: 133336 - RNA, 20 nt, Artificial Sequence
  mmSKRIPTE0004115_Nuggc_2
  gRNA
cuggaauagccggucccaag

SEQ ID NO: 133337 - RNA, 20 nt, Artificial Sequence
  mmSKRIPTE0004116_Nuggc_3
  gRNA
uggccugcgacaauuuguag

SEQ ID NO: 133338 - RNA, 20 nt, Artificial Sequence
  mmSKRIPTE0004117_Nuggc_4
  gRNA
ugaauccucagauaacuacc

SEQ ID NO: 133339 - RNA, 20 nt, Artificial Sequence
  mmSKRIPTE0004118_Nuggc_5
  gRNA
uacauguugaaacgacugca

SEQ ID NO: 133340 - RNA, 20 nt, Artificial Sequence
  mmSKRIPTE0004119_Nuggc_6
  gRNA
uaacacuugaaucuauccag

SEQ ID NO: 133341 - RNA, 20 nt, Artificial Sequence
  mmSKRIPTE0004120_Nuggc_7
  gRNA
caagcuaauagaaaacggga

SEQ ID NO: 133342 - RNA, 20 nt, Artificial Sequence
  mmSKRIPTE0004121_Nuggc_8
  gRNA
ccagugucuggcacacuacg

SEQ ID NO: 133343 - RNA, 20 nt, Artificial Sequence
  mmSKRIPTE0004122_Nuggc_9
  gRNA
caggcaacauguagauaacg

SEQ ID NO: 133344 - RNA, 20 nt, Artificial Sequence
  mmSKRIPTE0004123_Fyb_1
  gRNA
cacggggaguaacccgacag

SEQ ID NO: 133345 - RNA, 20 nt, Artificial Sequence
  mmSKRIPTE0004124_Fyb_2
  gRNA
gcaaagcucacaguacggca

SEQ ID NO: 133346 - RNA, 20 nt, Artificial Sequence
  mmSKRIPTE0004125_Fyb_3
  gRNA
cugacagcggggacaccgug

SEQ ID NO: 133347 - RNA, 20 nt, Artificial Sequence
  mmSKRIPTE0004126_Fyb_4
  gRNA
ggcagcgaaaccuaccuacg

SEQ ID NO: 133348 - RNA, 20 nt, Artificial Sequence
  mmSKRIPTE0004127_Fyb_5
  gRNA
ugaagucagauaacuaggag

SEQ ID NO: 133349 - RNA, 20 nt, Artificial Sequence
  mmSKRIPTE0004128_Fyb_6
  gRNA
ugauuuaggaacuaucuacg

SEQ ID NO: 133350 - RNA, 20 nt, Artificial Sequence
  mmSKRIPTE0004129_Fyb_7
  gRNA
gaauccgaacauccucacgc

SEQ ID NO: 133351 - RNA, 20 nt, Artificial Sequence
  mmSKRIPTE0004130_Fyb_8
  gRNA
gcucuaauuaagcuagccag

SEQ ID NO: 133352 - RNA, 20 nt, Artificial Sequence
  mmSKRIPTE0004131_Fyb_9
  gRNA
gcuccugagaacgacacuag

SEQ ID NO: 133353 - RNA, 20 nt, Artificial Sequence
  mmSKRIPTE0004132_Tap2_1
  gRNA
uuacacgacccgaauagcga

SEQ ID NO: 133354 - RNA, 20 nt, Artificial Sequence
  mmSKRIPTE0004133_Tap2_2
  gRNA
uagggguccgcccuucacca

SEQ ID NO: 133355 - RNA, 20 nt, Artificial Sequence
  mmSKRIPTE0004134_Tap2_3
  gRNA
gagcaccucaguaguccgag

SEQ ID NO: 133356 - RNA, 20 nt, Artificial Sequence
  mmSKRIPTE0004135_Tap2_4
  gRNA
acucaccugcggcugcggag

SEQ ID NO: 133357 - RNA, 20 nt, Artificial Sequence
  mmSKRIPTE0004136_Tap2_5
  gRNA
caggcaaggcacaaucugug

SEQ ID NO: 133358 - RNA, 20 nt, Artificial Sequence
  mmSKRIPTE0004137_Tap2_6
  gRNA
gaaccggaugaugacgccaa

SEQ ID NO: 133359 - RNA, 20 nt, Artificial Sequence
  mmSKRIPTE0004138_Tap2_7
  gRNA
gaugguugcauacacagucg

SEQ ID NO: 133360 - RNA, 20 nt, Artificial Sequence
  mmSKRIPTE0004139_Tap2_8
  gRNA
uccuggcucuuaaagacccg

SEQ ID NO: 133361 - RNA, 20 nt, Artificial Sequence
  mmSKRIPTE0004140_Tap2_9
  gRNA
aggcccaaagcgaaguacug

SEQ ID NO: 133362 - RNA, 20 nt, Artificial Sequence
  mmSKRIPTE0004141_Vegfa_1
  gRNA
caacggugacgaugauggcg

SEQ ID NO: 133363 - RNA, 20 nt, Artificial Sequence
  mmSKRIPTE0004142_Vegfa_2
  gRNA
aaauccuggagcguguacgu

SEQ ID NO: 133364 - RNA, 20 nt, Artificial Sequence
  mmSKRIPTE0004143_Vegfa_3
  gRNA
cauggggcccuauaaugccg

SEQ ID NO: 133365 - RNA, 20 nt, Artificial Sequence
  mmSKRIPTE0004144_Vegfa_4
  gRNA
cccaauagaacccucgagug

SEQ ID NO: 133366 - RNA, 20 nt, Artificial Sequence
  mmSKRIPTE0004145_Vegfa_5
  gRNA
cagacucgcguugcaaggcg

SEQ ID NO: 133367 - RNA, 20 nt, Artificial Sequence
  mmSKRIPTE0004146_Vegfa_6
  gRNA
gugcccauauuccagagacg

SEQ ID NO: 133368 - RNA, 20 nt, Artificial Sequence
  mmSKRIPTE0004147_Vegfa_7
  gRNA
aaacgaacguacuugcaggu

SEQ ID NO: 133369 - RNA, 20 nt, Artificial Sequence
  mmSKRIPTE0004148_Vegfa_8
  gRNA
aaucguggagagcuucggca

SEQ ID NO: 133370 - RNA, 20 nt, Artificial Sequence
  mmSKRIPTE0004149_Vegfa_9
  gRNA
ugauccgcaugaucuguaga

SEQ ID NO: 133371 - RNA, 20 nt, Artificial Sequence
  mmSKRIPTE0004150_Tfeb_1
  gRNA
gaggcacccaaggaccggug

SEQ ID NO: 133372 - RNA, 20 nt, Artificial Sequence
  mmSKRIPTE0004151_Tfeb_2
  gRNA
agucauaguacugccgccag

SEQ ID NO: 133373 - RNA, 20 nt, Artificial Sequence
  mmSKRIPTE0004152_Tfeb_3
  gRNA
gggugauacuaucuacccag

SEQ ID NO: 133374 - RNA, 20 nt, Artificial Sequence
  mmSKRIPTE0004153_Tfeb_4
  gRNA
cauauucacacccgacggcg

SEQ ID NO: 133375 - RNA, 20 nt, Artificial Sequence
  mmSKRIPTE0004154_Tfeb_5
  gRNA
ucauggcucagcucgcucag

SEQ ID NO: 133376 - RNA, 20 nt, Artificial Sequence
  mmSKRIPTE0004155_Tfeb_6
  gRNA
cuguaguugagagaagacgc

SEQ ID NO: 133377 - RNA, 20 nt, Artificial Sequence
  mmSKRIPTE0004156_Tfeb_7
  gRNA
cucucgcuucugagucaggu

SEQ ID NO: 133378 - RNA, 20 nt, Artificial Sequence
  mmSKRIPTE0004157_Tfeb_8
  gRNA
gugucccaagcuagggacgc

SEQ ID NO: 133379 - RNA, 20 nt, Artificial Sequence
  mmSKRIPTE0004158_Tfeb_9
  gRNA
agccaccugaacguguacag

SEQ ID NO: 133380 - RNA, 20 nt, Artificial Sequence
  mmSKRIPTE0004159_Dpp4_1
  gRNA
ugccucgauuauccacgcaa

SEQ ID NO: 133381 - RNA, 20 nt, Artificial Sequence
  mmSKRIPTE0004160_Dpp4_2
  gRNA
agucauaggaucacaucgac

SEQ ID NO: 133382 - RNA, 20 nt, Artificial Sequence
  mmSKRIPTE0004161_Dpp4_3
  gRNA
augauaagaucaaccuaacg

SEQ ID NO: 133383 - RNA, 20 nt, Artificial Sequence
  mmSKRIPTE0004162_Dpp4_4
  gRNA
uucaucaauauguaugcgau

SEQ ID NO: 133384 - RNA, 20 nt, Artificial Sequence
  mmSKRIPTE0004163_Dpp4_5
  gRNA
uuggaugggagccgcacuag

SEQ ID NO: 133385 - RNA, 20 nt, Artificial Sequence
  mmSKRIPTE0004164_Dpp4_6
  gRNA
gacauaugguaagcgagucg

SEQ ID NO: 133386 - RNA, 20 nt, Artificial Sequence
  mmSKRIPTE0004165_Dpp4_7
  gRNA
gagggugugaguauaacgca

SEQ ID NO: 133387 - RNA, 20 nt, Artificial Sequence
  mmSKRIPTE0004166_Dpp4_8
  gRNA
gccauuaggcggaagccacg

SEQ ID NO: 133388 - RNA, 20 nt, Artificial Sequence
  mmSKRIPTE0004167_Dpp4_9
  gRNA
gcagagacggacguccugcg

SEQ ID NO: 133389 - RNA, 20 nt, Artificial Sequence
  mmSKRIPTE0004168_Tnfsf10_1
  gRNA
gaagacguuuacaucgaaug

SEQ ID NO: 133390 - RNA, 20 nt, Artificial Sequence
  mmSKRIPTE0004169_Tnfsf10_2
  gRNA
ugcuuaguaucgauggacag

SEQ ID NO: 133391 - RNA, 20 nt, Artificial Sequence
  mmSKRIPTE0004170_Tnfsf10_3
  gRNA
uaaagccugcugcuccaucg

SEQ ID NO: 133392 - RNA, 20 nt, Artificial Sequence
  mmSKRIPTE0004171_Tnfsf10_4
  gRNA
ucccauccauacauacggug

SEQ ID NO: 133393 - RNA, 20 nt, Artificial Sequence
  mmSKRIPTE0004172_Tnfsf10_5
  gRNA
aaaugaaugcccuuuccgag

SEQ ID NO: 133394 - RNA, 20 nt, Artificial Sequence
  mmSKRIPTE0004173_Tnfsf10_6
  gRNA
cuaagacgagccugccaccu

SEQ ID NO: 133395 - RNA, 20 nt, Artificial Sequence
  mmSKRIPTE0004174_Tnfsf10_7
  gRNA
ccaacaggaucggaauccug

SEQ ID NO: 133396 - RNA, 20 nt, Artificial Sequence
  mmSKRIPTE0004175_Tnfsf10_8
  gRNA
cccagggucuuacucccagu

SEQ ID NO: 133397 - RNA, 20 nt, Artificial Sequence
  mmSKRIPTE0004176_Tnfsf10_9
  gRNA
agcggguguagaaauaggcc

SEQ ID NO: 133398 - RNA, 20 nt, Artificial Sequence
  mmSKRIPTE0004177_Jun_1
  gRNA
acgguccgucacuucacgcg

SEQ ID NO: 133399 - RNA, 20 nt, Artificial Sequence
  mmSKRIPTE0004178_Jun_2
  gRNA
gacuccgcuagcacucacgu

SEQ ID NO: 133400 - RNA, 20 nt, Artificial Sequence
  mmSKRIPTE0004179_Jun_3
  gRNA
acggacuuggccaacccggu

SEQ ID NO: 133401 - RNA, 20 nt, Artificial Sequence
  mmSKRIPTE0004180_Jun_4
  gRNA
gucgggagaauaguucaacc

SEQ ID NO: 133402 - RNA, 20 nt, Artificial Sequence
  mmSKRIPTE0004181_Jun_5
  gRNA
gcccaacuguaggagcgcag

SEQ ID NO: 133403 - RNA, 20 nt, Artificial Sequence
  mmSKRIPTE0004182_Jun_6
  gRNA
cgcgcgaggaaauaggcgag

SEQ ID NO: 133404 - RNA, 20 nt, Artificial Sequence
  mmSKRIPTE0004183_Jun_7
  gRNA
gaagguccgaguucuuggcg

SEQ ID NO: 133405 - RNA, 20 nt, Artificial Sequence
  mmSKRIPTE0004184_Jun_8
  gRNA
ucaugaaccacguuaacagu

SEQ ID NO: 133406 - RNA, 20 nt, Artificial Sequence
  mmSKRIPTE0004185_Jun_9
  gRNA
agucgucacggaauucucgg

SEQ ID NO: 133407 - RNA, 20 nt, Artificial Sequence
  mmSKRIPTE0004186_Il6_1
  gRNA
acuagagaguaagcguccag

SEQ ID NO: 133408 - RNA, 20 nt, Artificial Sequence
  mmSKRIPTE0004187_Il6_2
  gRNA
agucucaauagcuccgccag

SEQ ID NO: 133409 - RNA, 20 nt, Artificial Sequence
  mmSKRIPTE0004188_Il6_3
  gRNA
ccuacuucacaaguccggag

SEQ ID NO: 133410 - RNA, 20 nt, Artificial Sequence
  mmSKRIPTE0004189_Il6_4
  gRNA
gaaaaagugccgcuacccug

SEQ ID NO: 133411 - RNA, 20 nt, Artificial Sequence
  mmSKRIPTE0004190_Il6_5
  gRNA
aaacugaugaagacccagug

SEQ ID NO: 133412 - RNA, 20 nt, Artificial Sequence
  mmSKRIPTE0004191_Il6_6
  gRNA
agucugaauggaaaccacga

SEQ ID NO: 133413 - RNA, 20 nt, Artificial Sequence
  mmSKRIPTE0004192_Il6_7
  gRNA
cuggauggaagucuccugcg

SEQ ID NO: 133414 - RNA, 20 nt, Artificial Sequence
  mmSKRIPTE0004193_Il6_8
  gRNA
uuacuuaggaggucuaggaa

SEQ ID NO: 133415 - RNA, 20 nt, Artificial Sequence
  mmSKRIPTE0004194_Il6_9
  gRNA
uauaccacuucacaagucgg

SEQ ID NO: 133416 - RNA, 20 nt, Artificial Sequence
  mmSKRIPTE0004195_Nt5c3_1
  gRNA
guaaccggacaagcuacgua

SEQ ID NO: 133417 - RNA, 20 nt, Artificial Sequence
  mmSKRIPTE0004196_Nt5c3_2
  gRNA
uuuaucaaugaagcgaccga

SEQ ID NO: 133418 - RNA, 20 nt, Artificial Sequence
  mmSKRIPTE0004197_Nt5c3_3
  gRNA
aaacagccccgugacgcacg

SEQ ID NO: 133419 - RNA, 20 nt, Artificial Sequence
  mmSKRIPTE0004198_Nt5c3_4
  gRNA
acagacgaucuucagacgug

SEQ ID NO: 133420 - RNA, 20 nt, Artificial Sequence
  mmSKRIPTE0004199_Nt5c3_5
  gRNA
auagugaacauugcgcuggg

SEQ ID NO: 133421 - RNA, 20 nt, Artificial Sequence
  mmSKRIPTE0004200_Nt5c3_6
  gRNA
gacauugcaugcacccucag

SEQ ID NO: 133422 - RNA, 20 nt, Artificial Sequence
  mmSKRIPTE0004201_Nt5c3_7
  gRNA
cuguuaguauaucucagccg

SEQ ID NO: 133423 - RNA, 20 nt, Artificial Sequence
  mmSKRIPTE0004202_Nt5c3_8
  gRNA
gguguauguaaugcgaggca

SEQ ID NO: 133424 - RNA, 20 nt, Artificial Sequence
  mmSKRIPTE0004203_Nt5c3_9
  gRNA
aucaucuuaaggcacaucgc

SEQ ID NO: 133425 - RNA, 20 nt, Artificial Sequence
  mmSKRIPTE0004204_Igkc_1
  gRNA
cagcacccucacguugacca

SEQ ID NO: 133426 - RNA, 20 nt, Artificial Sequence
  mmSKRIPTE0004205_Igkc_2
  gRNA
guucaagaagcacacgacug

SEQ ID NO: 133427 - RNA, 20 nt, Artificial Sequence
  mmSKRIPTE0004206_Igkc_3
  gRNA
acagugguaggucgcuugug

SEQ ID NO: 133428 - RNA, 20 nt, Artificial Sequence
  mmSKRIPTE0004207_Igkc_4
  gRNA
auguaguggacagccaacca

SEQ ID NO: 133429 - RNA, 20 nt, Artificial Sequence
  mmSKRIPTE0004208_Igkc_5
  gRNA
augucguucauacucguccu

SEQ ID NO: 133430 - RNA, 20 nt, Artificial Sequence
  mmSKRIPTE0004209_Igkc_6
  gRNA
gaggaugguaugaaguaaca

SEQ ID NO: 133431 - RNA, 20 nt, Artificial Sequence
  mmSKRIPTE0004210_Igkc_7
  gRNA
agugagcaguuaacaucugg

SEQ ID NO: 133432 - RNA, 20 nt, Artificial Sequence
  mmSKRIPTE0004211_Igkc_8
  gRNA
acauaacagcuauaccugug

SEQ ID NO: 133433 - RNA, 20 nt, Artificial Sequence
  mmSKRIPTE0004212_Igkc_9
  gRNA
aguacucgugaaccuuagaa

SEQ ID NO: 133434 - RNA, 20 nt, Artificial Sequence
  mmSKRIPTE0004213_Atp7a_1
  gRNA
caauagaggccauuucaccg

SEQ ID NO: 133435 - RNA, 20 nt, Artificial Sequence
  mmSKRIPTE0004214_Atp7a_2
  gRNA
aacucauaauugucauacgu

SEQ ID NO: 133436 - RNA, 20 nt, Artificial Sequence
  mmSKRIPTE0004215_Atp7a_3
  gRNA
aguagggcccacaugguacg

SEQ ID NO: 133437 - RNA, 20 nt, Artificial Sequence
  mmSKRIPTE0004216_Atp7a_4
  gRNA
gcuagccaagucgucuacug

SEQ ID NO: 133438 - RNA, 20 nt, Artificial Sequence
  mmSKRIPTE0004217_Atp7a_5
  gRNA
ugugaccuuaaggacuacag

SEQ ID NO: 133439 - RNA, 20 nt, Artificial Sequence
  mmSKRIPTE0004218_Atp7a_6
  gRNA
ccuauauacuugccccacug

SEQ ID NO: 133440 - RNA, 20 nt, Artificial Sequence
  mmSKRIPTE0004219_Atp7a_7
  gRNA
uauauaugagaagugguacg

SEQ ID NO: 133441 - RNA, 20 nt, Artificial Sequence
  mmSKRIPTE0004220_Atp7a_8
  gRNA
aaaagagugaagucgccgau

SEQ ID NO: 133442 - RNA, 20 nt, Artificial Sequence
  mmSKRIPTE0004221_Atp7a_9
  gRNA
ucuauagggcaaaaccuccg

SEQ ID NO: 133443 - RNA, 20 nt, Artificial Sequence
  mmSKRIPTE0004222_Flcn_1
  gRNA
accaaacuguagcgucgaag

SEQ ID NO: 133444 - RNA, 20 nt, Artificial Sequence
  mmSKRIPTE0004223_Flcn_2
  gRNA
guacagccauagguacccug

SEQ ID NO: 133445 - RNA, 20 nt, Artificial Sequence
  mmSKRIPTE0004224_Flcn_3
  gRNA
agaauacaaugccggucaug

SEQ ID NO: 133446 - RNA, 20 nt, Artificial Sequence
  mmSKRIPTE0004225_Flcn_4
  gRNA
agauggggccuucacgacca

SEQ ID NO: 133447 - RNA, 20 nt, Artificial Sequence
  mmSKRIPTE0004226_Flcn_5
  gRNA
acgccuaucguaucccagag

SEQ ID NO: 133448 - RNA, 20 nt, Artificial Sequence
  mmSKRIPTE0004227_Flcn_6
  gRNA
caaguggcccauaacaguag

SEQ ID NO: 133449 - RNA, 20 nt, Artificial Sequence
  mmSKRIPTE0004228_Flcn_7
  gRNA
gauguccacagcgugcccag

SEQ ID NO: 133450 - RNA, 20 nt, Artificial Sequence
  mmSKRIPTE0004229_Flcn_8
  gRNA
cacgacaacuacgaacucug

SEQ ID NO: 133451 - RNA, 20 nt, Artificial Sequence
  mmSKRIPTE0004230_Flcn_9
  gRNA
aagcacgcauccuggaaacg

SEQ ID NO: 133452 - RNA, 20 nt, Artificial Sequence
  mmSKRIPTE0004231_Hoxb7_1
  gRNA
ccgucauaccauuggccgag

SEQ ID NO: 133453 - RNA, 20 nt, Artificial Sequence
  mmSKRIPTE0004232_Hoxb7_2
  gRNA
cagcccagacuuaaacggcg

SEQ ID NO: 133454 - RNA, 20 nt, Artificial Sequence
  mmSKRIPTE0004233_Hoxb7_3
  gRNA
auauuagugucccuagagug

SEQ ID NO: 133455 - RNA, 20 nt, Artificial Sequence
  mmSKRIPTE0004234_Hoxb7_4
  gRNA
ucugcaccuaguagugaaag

SEQ ID NO: 133456 - RNA, 20 nt, Artificial Sequence
  mmSKRIPTE0004235_Hoxb7_5
  gRNA
cauuacugggagccuccggg

SEQ ID NO: 133457 - RNA, 20 nt, Artificial Sequence
  mmSKRIPTE0004236_Hoxb7_6
  gRNA
aggcgcaagaaguuuguucg

SEQ ID NO: 133458 - RNA, 20 nt, Artificial Sequence
  mmSKRIPTE0004237_Hoxb7_7
  gRNA
uuccagcaagguaaccaccu

SEQ ID NO: 133459 - RNA, 20 nt, Artificial Sequence
  mmSKRIPTE0004238_Hoxb7_8
  gRNA
ggaguacagacccugcaccg

SEQ ID NO: 133460 - RNA, 20 nt, Artificial Sequence
  mmSKRIPTE0004239_Hoxb7_9
  gRNA
guagggccugaccgaaagcg

SEQ ID NO: 133461 - RNA, 20 nt, Artificial Sequence
  mmSKRIPTE0004240_Cd300lf_1
  gRNA
uuggugcuuuauaugccagc

SEQ ID NO: 133462 - RNA, 20 nt, Artificial Sequence
  mmSKRIPTE0004241_Cd300lf_2
  gRNA
guucacuuuccaaggcggug

SEQ ID NO: 133463 - RNA, 20 nt, Artificial Sequence
  mmSKRIPTE0004242_Cd300lf_3
  gRNA
ugauggccaugagagacgga

SEQ ID NO: 133464 - RNA, 20 nt, Artificial Sequence
  mmSKRIPTE0004243_Cd300lf_4
  gRNA
ccagccaccuuagauagcag

SEQ ID NO: 133465 - RNA, 20 nt, Artificial Sequence
  mmSKRIPTE0004244_Cd300lf_5
  gRNA
agugccgauauaccucaggc

SEQ ID NO: 133466 - RNA, 20 nt, Artificial Sequence
  mmSKRIPTE0004245_Cd300lf_6
  gRNA
aggaggugcugggcucacau

SEQ ID NO: 133467 - RNA, 20 nt, Artificial Sequence
  mmSKRIPTE0004246_Cd300lf_7
  gRNA
gucaggucucccauucuggu

SEQ ID NO: 133468 - RNA, 20 nt, Artificial Sequence
  mmSKRIPTE0004247_Cd300lf_8
  gRNA
gccccaugaaagacguacca

SEQ ID NO: 133469 - RNA, 20 nt, Artificial Sequence
  mmSKRIPTE0004248_Cd300lf_9
  gRNA
uugaacuccaagcucaagca

SEQ ID NO: 133470 - RNA, 20 nt, Artificial Sequence
  mmSKRIPTE0004249_Iuga6_1
  gRNA
ccgaccaacuggucuaggac

SEQ ID NO: 133471 - RNA, 20 nt, Artificial Sequence
  mmSKRIPTE0004250_Iuga6_2
  gRNA
aaacaguacauccacugccg

SEQ ID NO: 133472 - RNA, 20 nt, Artificial Sequence
  mmSKRIPTE0004251_Iuga6_3
  gRNA
uugaccaggucaaggcggug

SEQ ID NO: 133473 - RNA, 20 nt, Artificial Sequence
  mmSKRIPTE0004252_Iuga6_4
  gRNA
cagcauuccccgauaccaug

SEQ ID NO: 133474 - RNA, 20 nt, Artificial Sequence
  mmSKRIPTE0004253_Iuga6_5
  gRNA
ucguucucccuggcgcagcg

SEQ ID NO: 133475 - RNA, 20 nt, Artificial Sequence
  mmSKRIPTE0004254_Iuga6_6
  gRNA
ccguguacaagguccccggg

SEQ ID NO: 133476 - RNA, 20 nt, Artificial Sequence
  mmSKRIPTE0004255_Iuga6_7
  gRNA
guguauuccagguucucgag

SEQ ID NO: 133477 - RNA, 20 nt, Artificial Sequence
  mmSKRIPTE0004256_Iuga6_8
  gRNA
cccuucucuagaccuacgga

SEQ ID NO: 133478 - RNA, 20 nt, Artificial Sequence
  mmSKRIPTE0004257_Iuga6_9
  gRNA
aagaauccuugucagcacgu

SEQ ID NO: 133479 - RNA, 20 nt, Artificial Sequence
  mmSKRIPTE0004258_Mavs_1
  gRNA
gcacuugaagucaucccgag

SEQ ID NO: 133480 - RNA, 20 nt, Artificial Sequence
  mmSKRIPTE0004259_Mavs_2
  gRNA
uggaugaugagauaccuagu

SEQ ID NO: 133481 - RNA, 20 nt, Artificial Sequence
  mmSKRIPTE0004260_Mavs_3
  gRNA
gaacucuuacacugccacgu

SEQ ID NO: 133482 - RNA, 20 nt, Artificial Sequence
  mmSKRIPTE0004261_Mavs_4
  gRNA
gggcucugcacagucgaacg

SEQ ID NO: 133483 - RNA, 20 nt, Artificial Sequence
  mmSKRIPTE0004262_Mavs_5
  gRNA
acgccugaccaauagcugcg

SEQ ID NO: 133484 - RNA, 20 nt, Artificial Sequence
  mmSKRIPTE0004263_Mavs_6
  gRNA
uggcuacgagcaacgaccug

SEQ ID NO: 133485 - RNA, 20 nt, Artificial Sequence
  mmSKRIPTE0004264_Mavs_7
  gRNA
aggcccuggugacucgagcg

SEQ ID NO: 133486 - RNA, 20 nt, Artificial Sequence
  mmSKRIPTE0004265_Mavs_8
  gRNA
cuuguucccaauguagauag

SEQ ID NO: 133487 - RNA, 20 nt, Artificial Sequence
  mmSKRIPTE0004266_Mavs_9
  gRNA
uuuguccucagggcaguacg

SEQ ID NO: 133488 - RNA, 20 nt, Artificial Sequence
  mmSKRIPTE0004267_Rab32_1
  gRNA
aucaccaucaccaggccgag

SEQ ID NO: 133489 - RNA, 20 nt, Artificial Sequence
  mmSKRIPTE0004268_Rab32_2
  gRNA
aguccacgccaaugguggcg

SEQ ID NO: 133490 - RNA, 20 nt, Artificial Sequence
  mmSKRIPTE0004269_Rab32_3
  gRNA
ugggucuuccuaagugcccg

SEQ ID NO: 133491 - RNA, 20 nt, Artificial Sequence
  mmSKRIPTE0004270_Rab32_4
  gRNA
aggcccugugacuuuacccg

SEQ ID NO: 133492 - RNA, 20 nt, Artificial Sequence
  mmSKRIPTE0004271_Rab32_5
  gRNA
ggauaauauaaacaucgacg

SEQ ID NO: 133493 - RNA, 20 nt, Artificial Sequence
  mmSKRIPTE0004272_Rab32_6
  gRNA
cggugacucgcgugacugcg

SEQ ID NO: 133494 - RNA, 20 nt, Artificial Sequence
  mmSKRIPTE0004273_Rab32_7
  gRNA
uagguccauaucuggcacau

SEQ ID NO: 133495 - RNA, 20 nt, Artificial Sequence
  mmSKRIPTE0004274_Rab32_8
  gRNA
gcggugccuguacagcugaa

SEQ ID NO: 133496 - RNA, 20 nt, Artificial Sequence
  mmSKRIPTE0004275_Rab32_9
  gRNA
uaaacguucagugcaguaag

SEQ ID NO: 133497 - RNA, 20 nt, Artificial Sequence
  mmSKRIPTE0004276_Suau6_1
  gRNA
accauugcacacgucauccg

SEQ ID NO: 133498 - RNA, 20 nt, Artificial Sequence
  mmSKRIPTE0004277_Suau6_2
  gRNA
gugucgucagagcgccaggg

SEQ ID NO: 133499 - RNA, 20 nt, Artificial Sequence
  mmSKRIPTE0004278_Suau6_3
  gRNA
caacuuucgaaggacucggg

SEQ ID NO: 133500 - RNA, 20 nt, Artificial Sequence
  mmSKRIPTE0004279_Suau6_4
  gRNA
gauccauucucaacccacca

SEQ ID NO: 133501 - RNA, 20 nt, Artificial Sequence
  mmSKRIPTE0004280_Suau6_5
  gRNA
ccccgaaaauccaucccucg

SEQ ID NO: 133502 - RNA, 20 nt, Artificial Sequence
  mmSKRIPTE0004281_Suau6_6
  gRNA
cuaagcuacacaacgagcag

SEQ ID NO: 133503 - RNA, 20 nt, Artificial Sequence
  mmSKRIPTE0004282_Suau6_7
  gRNA
ggaguaagucagaugcggug

SEQ ID NO: 133504 - RNA, 20 nt, Artificial Sequence
  mmSKRIPTE0004283_Suau6_8
  gRNA
gugaaccuguauguacccgg

SEQ ID NO: 133505 - RNA, 20 nt, Artificial Sequence
  mmSKRIPTE0004284_Suau6_9
  gRNA
auaaagcgcugugagcggaa

SEQ ID NO: 133506 - RNA, 20 nt, Artificial Sequence
  mmSKRIPTE0004285_Sp7_1
  gRNA
caaacaucagcgcacccacg

SEQ ID NO: 133507 - RNA, 20 nt, Artificial Sequence
  mmSKRIPTE0004286_Sp7_2
  gRNA
ugacucaucccuauggcucg

SEQ ID NO: 133508 - RNA, 20 nt, Artificial Sequence
  mmSKRIPTE0004287_Sp7_3
  gRNA
ugcgggacucaacaacccug

SEQ ID NO: 133509 - RNA, 20 nt, Artificial Sequence
  mmSKRIPTE0004288_Sp7_4
  gRNA
ucaggagcuagagcggcucg

SEQ ID NO: 133510 - RNA, 20 nt, Artificial Sequence
  mmSKRIPTE0004289_Sp7_5
  gRNA
agaaacucucggagaccucg

SEQ ID NO: 133511 - RNA, 20 nt, Artificial Sequence
  mmSKRIPTE0004290_Sp7_6
  gRNA
caugcaaggagauaaccuag

SEQ ID NO: 133512 - RNA, 20 nt, Artificial Sequence
  mmSKRIPTE0004291_Sp7_7
  gRNA
agugaaaccuccuagauugg

SEQ ID NO: 133513 - RNA, 20 nt, Artificial Sequence
  mmSKRIPTE0004292_Sp7_8
  gRNA
ggcgaaguggaagaucgggg

SEQ ID NO: 133514 - RNA, 20 nt, Artificial Sequence
  mmSKRIPTE0004293_Sp7_9
  gRNA
aacaguuaccucaagcagag

SEQ ID NO: 133515 - RNA, 20 nt, Artificial Sequence
  mmSKRIPTE0004294_Prdx3_1
  gRNA
cacgauaggcggagauaccg

SEQ ID NO: 133516 - RNA, 20 nt, Artificial Sequence
  mmSKRIPTE0004295_Prdx3_2
  gRNA
gggaaaagggucguuaacaa

SEQ ID NO: 133517 - RNA, 20 nt, Artificial Sequence
  mmSKRIPTE0004296_Prdx3_3
  gRNA
aggaaaacaacauaccguag

SEQ ID NO: 133518 - RNA, 20 nt, Artificial Sequence
  mmSKRIPTE0004297_Prdx3_4
  gRNA
cucaaggauaaucuaccaag

SEQ ID NO: 133519 - RNA, 20 nt, Artificial Sequence
  mmSKRIPTE0004298_Prdx3_5
  gRNA
ucuagccgcaggaggccuag

SEQ ID NO: 133520 - RNA, 20 nt, Artificial Sequence
  mmSKRIPTE0004299_Prdx3_6
  gRNA
ccuguuugacagacauacug

SEQ ID NO: 133521 - RNA, 20 nt, Artificial Sequence
  mmSKRIPTE0004300_Prdx3_7
  gRNA
acaagccucaaguauagcca

SEQ ID NO: 133522 - RNA, 20 nt, Artificial Sequence
  mmSKRIPTE0004301_Prdx3_8
  gRNA
uaaaagaggaauuucagcgu

SEQ ID NO: 133523 - RNA, 20 nt, Artificial Sequence
  mmSKRIPTE0004302_Prdx3_9
  gRNA
ucguaagccccgccucgcug

SEQ ID NO: 133524 - RNA, 20 nt, Artificial Sequence
  mmSKRIPTE0004303_Acvr2a_1
  gRNA
aacgccuggcugaggcgacg

SEQ ID NO: 133525 - RNA, 20 nt, Artificial Sequence
  mmSKRIPTE0004304_Acvr2a_2
  gRNA
aaacauauucggaagccccg

SEQ ID NO: 133526 - RNA, 20 nt, Artificial Sequence
  mmSKRIPTE0004305_Acvr2a_3
  gRNA
ucaugggaccaauaauugug

SEQ ID NO: 133527 - RNA, 20 nt, Artificial Sequence
  mmSKRIPTE0004306_Acvr2a_4
  gRNA
uuagaugcuagggcauuagu

SEQ ID NO: 133528 - RNA, 20 nt, Artificial Sequence
  mmSKRIPTE0004307_Acvr2a_5
  gRNA
aggucaacagacuuuaagug

SEQ ID NO: 133529 - RNA, 20 nt, Artificial Sequence
  mmSKRIPTE0004308_Acvr2a_6
  gRNA
cacaguagccgagcucgcgg

SEQ ID NO: 133530 - RNA, 20 nt, Artificial Sequence
  mmSKRIPTE0004309_Acvr2a_7
  gRNA
gaaaugaguaggaugccucc

SEQ ID NO: 133531 - RNA, 20 nt, Artificial Sequence
  mmSKRIPTE0004310_Acvr2a_8
  gRNA
gcgcgaggagauuguccggg

SEQ ID NO: 133532 - RNA, 20 nt, Artificial Sequence
  mmSKRIPTE0004311_Acvr2a_9
  gRNA
aggauagauauguacgccau

SEQ ID NO: 133533 - RNA, 20 nt, Artificial Sequence
  mmSKRIPTE0004312_Adar_1
  gRNA
gggccauugugauaagcgug

SEQ ID NO: 133534 - RNA, 20 nt, Artificial Sequence
  mmSKRIPTE0004313_Adar_2
  gRNA
acagaacugggguaacgcag

SEQ ID NO: 133535 - RNA, 20 nt, Artificial Sequence
  mmSKRIPTE0004314_Adar_3
  gRNA
ugaggagacaugcacgcgag

SEQ ID NO: 133536 - RNA, 20 nt, Artificial Sequence
  mmSKRIPTE0004315_Adar_4
  gRNA
ucgguccuuagccugaauag

SEQ ID NO: 133537 - RNA, 20 nt, Artificial Sequence
  mmSKRIPTE0004316_Adar_5
  gRNA
aagcugaaagcuauguaccg

SEQ ID NO: 133538 - RNA, 20 nt, Artificial Sequence
  mmSKRIPTE0004317_Adar_6
  gRNA
uugaccacgucaaaagcucg

SEQ ID NO: 133539 - RNA, 20 nt, Artificial Sequence
  mmSKRIPTE0004318_Adar_7
  gRNA
cggccgaccuaggaaccacg

SEQ ID NO: 133540 - RNA, 20 nt, Artificial Sequence
  mmSKRIPTE0004319_Adar_8
  gRNA
ucuggcagcacggcgccaug

SEQ ID NO: 133541 - RNA, 20 nt, Artificial Sequence
  mmSKRIPTE0004320_Adar_9
  gRNA
ucgcguagugugaauuacga

SEQ ID NO: 133542 - RNA, 20 nt, Artificial Sequence
  mmSKRIPTE0004321_Runx3_1
  gRNA
auuugcaggagcccauaccg

SEQ ID NO: 133543 - RNA, 20 nt, Artificial Sequence
  mmSKRIPTE0004322_Runx3_2
  gRNA
ccguugggaacgguacaccg

SEQ ID NO: 133544 - RNA, 20 nt, Artificial Sequence
  mmSKRIPTE0004323_Runx3_3
  gRNA
agaaucaaguggcggcgacg

SEQ ID NO: 133545 - RNA, 20 nt, Artificial Sequence
  mmSKRIPTE0004324_Runx3_4
  gRNA
aaagcuaguucgucucagca

SEQ ID NO: 133546 - RNA, 20 nt, Artificial Sequence
  mmSKRIPTE0004325_Runx3_5
  gRNA
uugguguuacacgcaugcgc

SEQ ID NO: 133547 - RNA, 20 nt, Artificial Sequence
  mmSKRIPTE0004326_Runx3_6
  gRNA
uacacucgcaggucucccga

SEQ ID NO: 133548 - RNA, 20 nt, Artificial Sequence
  mmSKRIPTE0004327_Runx3_7
  gRNA
acagaggacuuguacccccg

SEQ ID NO: 133549 - RNA, 20 nt, Artificial Sequence
  mmSKRIPTE0004328_Runx3_8
  gRNA
guguugcacagggcgaccgu

SEQ ID NO: 133550 - RNA, 20 nt, Artificial Sequence
  mmSKRIPTE0004329_Runx3_9
  gRNA
gcucaguagcacuuacgucg

SEQ ID NO: 133551 - RNA, 20 nt, Artificial Sequence
  mmSKRIPTE0004330_Cftr_1
  gRNA
ccacuccagcuuaauccuag

SEQ ID NO: 133552 - RNA, 20 nt, Artificial Sequence
  mmSKRIPTE0004331_Cftr_2
  gRNA
accauaucuguacggcagug

SEQ ID NO: 133553 - RNA, 20 nt, Artificial Sequence
  mmSKRIPTE0004332_Cftr_3
  gRNA
ugaauguaucuuaaccugag

SEQ ID NO: 133554 - RNA, 20 nt, Artificial Sequence
  mmSKRIPTE0004333_Cftr_4
  gRNA
cgaagggcguggauaagcug

SEQ ID NO: 133555 - RNA, 20 nt, Artificial Sequence
  mmSKRIPTE0004334_Cftr_5
  gRNA
gccgugugacugacauacgu

SEQ ID NO: 133556 - RNA, 20 nt, Artificial Sequence
  mmSKRIPTE0004335_Cftr_6
  gRNA
uucugcaugaugucuccgug

SEQ ID NO: 133557 - RNA, 20 nt, Artificial Sequence
  mmSKRIPTE0004336_Cftr_7
  gRNA
auauuguugggaaucagcga

SEQ ID NO: 133558 - RNA, 20 nt, Artificial Sequence
  mmSKRIPTE0004337_Cftr_8
  gRNA
guggcgaucauguugcugcg

SEQ ID NO: 133559 - RNA, 20 nt, Artificial Sequence
  mmSKRIPTE0004338_Cftr_9
  gRNA
guguucggcuaaauucaggu

SEQ ID NO: 133560 - RNA, 20 nt, Artificial Sequence
  mmSKRIPTE0004339_March8_1
  gRNA
gcguugcccauggcuacgag

SEQ ID NO: 133561 - RNA, 20 nt, Artificial Sequence
  mmSKRIPTE0004340_March8_2
  gRNA
uguaaguguauacggaucug

SEQ ID NO: 133562 - RNA, 20 nt, Artificial Sequence
  mmSKRIPTE0004341_March8_3
  gRNA
aggaucccugagcaacgcuu

SEQ ID NO: 133563 - RNA, 20 nt, Artificial Sequence
  mmSKRIPTE0004342_March8_4
  gRNA
uggcacugcagcauacagau

SEQ ID NO: 133564 - RNA, 20 nt, Artificial Sequence
  mmSKRIPTE0004343_March8_5
  gRNA
gcccaaaaugacucugcuag

SEQ ID NO: 133565 - RNA, 20 nt, Artificial Sequence
  mmSKRIPTE0004344_March8_6
  gRNA
cuaaaucagaugcuacaaca

SEQ ID NO: 133566 - RNA, 20 nt, Artificial Sequence
  mmSKRIPTE0004345_March8_7
  gRNA
auuaacgucugaccauguga

SEQ ID NO: 133567 - RNA, 20 nt, Artificial Sequence
  mmSKRIPTE0004346_March8_8
  gRNA
aaguccuccagugaagccga

SEQ ID NO: 133568 - RNA, 20 nt, Artificial Sequence
  mmSKRIPTE0004347_March8_9
  gRNA
gacccguuccuggugugcug

SEQ ID NO: 133569 - RNA, 20 nt, Artificial Sequence
  mmSKRIPTE0004348_Cd4_1
  gRNA
agacaucucacuacggucag

SEQ ID NO: 133570 - RNA, 20 nt, Artificial Sequence
  mmSKRIPTE0004349_Cd4_2
  gRNA
cgggcgaugagacaggacgc

SEQ ID NO: 133571 - RNA, 20 nt, Artificial Sequence
  mmSKRIPTE0004350_Cd4_3
  gRNA
uacacagcacaguuuacgag

SEQ ID NO: 133572 - RNA, 20 nt, Artificial Sequence
  mmSKRIPTE0004351_Cd4_4
  gRNA
cuugagugucugaaacgcag

SEQ ID NO: 133573 - RNA, 20 nt, Artificial Sequence
  mmSKRIPTE0004352_Cd4_5
  gRNA
cgggguucaagcuguaagcg

SEQ ID NO: 133574 - RNA, 20 nt, Artificial Sequence
  mmSKRIPTE0004353_Cd4_6
  gRNA
gccucacucuaagagaacua

SEQ ID NO: 133575 - RNA, 20 nt, Artificial Sequence
  mmSKRIPTE0004354_Cd4_7
  gRNA
uaucacggccuauaagagug

SEQ ID NO: 133576 - RNA, 20 nt, Artificial Sequence
  mmSKRIPTE0004355_Cd4_8
  gRNA
aguaacuggaggauacaagu

SEQ ID NO: 133577 - RNA, 20 nt, Artificial Sequence
  mmSKRIPTE0004356_Cd4_9
  gRNA
ugucacucaagggaagacgc

SEQ ID NO: 133578 - RNA, 20 nt, Artificial Sequence
  mmSKRIPTE0004357_Gpx1_1
  gRNA
uggauggugcugagaucacg

SEQ ID NO: 133579 - RNA, 20 nt, Artificial Sequence
  mmSKRIPTE0004358_Gpx1_2
  gRNA
cuccuuguauaaccgaggau

SEQ ID NO: 133580 - RNA, 20 nt, Artificial Sequence
  mmSKRIPTE0004359_Gpx1_3
  gRNA
ggucggucaugagcgcagug

SEQ ID NO: 133581 - RNA, 20 nt, Artificial Sequence
  mmSKRIPTE0004360_Gpx1_4
  gRNA
ugcgcacgggaacaccgucg

SEQ ID NO: 133582 - RNA, 20 nt, Artificial Sequence
  mmSKRIPTE0004361_Gpx1_5
  gRNA
aauccguacuagcgcucaca

SEQ ID NO: 133583 - RNA, 20 nt, Artificial Sequence
  mmSKRIPTE0004362_Gpx1_6
  gRNA
guaagcggugucccgcccgu

SEQ ID NO: 133584 - RNA, 20 nt, Artificial Sequence
  mmSKRIPTE0004363_Gpx1_7
  gRNA
cucgguguagucccggaucg

SEQ ID NO: 133585 - RNA, 20 nt, Artificial Sequence
  mmSKRIPTE0004364_Gpx1_8
  gRNA
uuccgcaggaagguaaagag

SEQ ID NO: 133586 - RNA, 20 nt, Artificial Sequence
  mmSKRIPTE0004365_Gpx1_9
  gRNA
gguguccgaacugauugcac

SEQ ID NO: 133587 - RNA, 20 nt, Artificial Sequence
  mmSKRIPTE0004366_Traf3ip1_1
  gRNA
cagcgccaugaacgccgcag

SEQ ID NO: 133588 - RNA, 20 nt, Artificial Sequence
  mmSKRIPTE0004367_Traf3ip1_2
  gRNA
aagcagauuaaaacgcugcg

SEQ ID NO: 133589 - RNA, 20 nt, Artificial Sequence
  mmSKRIPTE0004368_Traf3ip1_3
  gRNA
uguuucauaucauacccgug

SEQ ID NO: 133590 - RNA, 20 nt, Artificial Sequence
  mmSKRIPTE0004369_Traf3ip1_4
  gRNA
cacgacaucaucaccgaggu

SEQ ID NO: 133591 - RNA, 20 nt, Artificial Sequence
  mmSKRIPTE0004370_Traf3ip1_5
  gRNA
ucugagugucaugccgaccg

SEQ ID NO: 133592 - RNA, 20 nt, Artificial Sequence
  mmSKRIPTE0004371_Traf3ip1_6
  gRNA
cacuggucaaaacagccuag

SEQ ID NO: 133593 - RNA, 20 nt, Artificial Sequence
  mmSKRIPTE0004372_Traf3ip1_7
  gRNA
gguacagccccucaauacaa

SEQ ID NO: 133594 - RNA, 20 nt, Artificial Sequence
  mmSKRIPTE0004373_Traf3ip1_8
  gRNA
uaggcacacguucaaaagug

SEQ ID NO: 133595 - RNA, 20 nt, Artificial Sequence
  mmSKRIPTE0004374_Traf3ip1_9
  gRNA
gugcgcgucagguugaggug

SEQ ID NO: 133596 - RNA, 20 nt, Artificial Sequence
  mmSKRIPTE0004375_Shmt2_1
  gRNA
ccgcggucggaaaagccgag

SEQ ID NO: 133597 - RNA, 20 nt, Artificial Sequence
  mmSKRIPTE0004376_Shmt2_2
  gRNA
ucuguaucgguguaguaccg

SEQ ID NO: 133598 - RNA, 20 nt, Artificial Sequence
  mmSKRIPTE0004377_Shmt2_3
  gRNA
cggagcgccauuacuccggg

SEQ ID NO: 133599 - RNA, 20 nt, Artificial Sequence
  mmSKRIPTE0004378_Shmt2_4
  gRNA
gcacuuguaaggaguacucg

SEQ ID NO: 133600 - RNA, 20 nt, Artificial Sequence
  mmSKRIPTE0004379_Shmt2_5
  gRNA
gaacuggcgagaggucaacg

SEQ ID NO: 133601 - RNA, 20 nt, Artificial Sequence
  mmSKRIPTE0004380_Shmt2_6
  gRNA
uuccacggcagauacuacgg

SEQ ID NO: 133602 - RNA, 20 nt, Artificial Sequence
  mmSKRIPTE0004381_Shmt2_7
  gRNA
ccgaggagagcggaccaucg

SEQ ID NO: 133603 - RNA, 20 nt, Artificial Sequence
  mmSKRIPTE0004382_Shmt2_8
  gRNA
ggaccacucggguaagaaca

SEQ ID NO: 133604 - RNA, 20 nt, Artificial Sequence
  mmSKRIPTE0004383_Shmt2_9
  gRNA
uucuggcgaucagacgaccu

SEQ ID NO: 133605 - RNA, 20 nt, Artificial Sequence
  mmSKRIPTE0004384_Gas2l1_1
  gRNA
cggucucgagacuggcugcg

SEQ ID NO: 133606 - RNA, 20 nt, Artificial Sequence
  mmSKRIPTE0004385_Gas2l1_2
  gRNA
aucgggacccauagaacucg

SEQ ID NO: 133607 - RNA, 20 nt, Artificial Sequence
  mmSKRIPTE0004386_Gas2l1_3
  gRNA
gggacaaguuggcacccacg

SEQ ID NO: 133608 - RNA, 20 nt, Artificial Sequence
  mmSKRIPTE0004387_Gas2l1_4
  gRNA
gcgacccuuccgauccagug

SEQ ID NO: 133609 - RNA, 20 nt, Artificial Sequence
  mmSKRIPTE0004388_Gas2l1_5
  gRNA
uaagggcaggcauucgccga

SEQ ID NO: 133610 - RNA, 20 nt, Artificial Sequence
  mmSKRIPTE0004389_Gas2l1_6
  gRNA
uugugccauguagucccgug

SEQ ID NO: 133611 - RNA, 20 nt, Artificial Sequence
  mmSKRIPTE0004390_Gas2l1_7
  gRNA
ggguuggaucagccaccgcc

SEQ ID NO: 133612 - RNA, 20 nt, Artificial Sequence
  mmSKRIPTE0004391_Gas2l1_8
  gRNA
uagaagacgagcagcgacaa

SEQ ID NO: 133613 - RNA, 20 nt, Artificial Sequence
  mmSKRIPTE0004392_Gas2l1_9
  gRNA
ccgagacggccagcacucgu

SEQ ID NO: 133614 - RNA, 20 nt, Artificial Sequence
  mmSKRIPTE0004393_Cd300a_1
  gRNA
cuccuagcuacacugacgca

SEQ ID NO: 133615 - RNA, 20 nt, Artificial Sequence
  mmSKRIPTE0004394_Cd300a_2
  gRNA
gagcugaugaaccccccgug

SEQ ID NO: 133616 - RNA, 20 nt, Artificial Sequence
  mmSKRIPTE0004395_Cd300a_3
  gRNA
uaccuacuuaagccccugug

SEQ ID NO: 133617 - RNA, 20 nt, Artificial Sequence
  mmSKRIPTE0004396_Cd300a_4
  gRNA
cgcccuaggauccaacacag

SEQ ID NO: 133618 - RNA, 20 nt, Artificial Sequence
  mmSKRIPTE0004397_Cd300a_5
  gRNA
ccacgguucagucccgcugg

SEQ ID NO: 133619 - RNA, 20 nt, Artificial Sequence
  mmSKRIPTE0004398_Cd300a_6
  gRNA
gcugcagacaauguaggcgu

SEQ ID NO: 133620 - RNA, 20 nt, Artificial Sequence
  mmSKRIPTE0004399_Cd300a_7
  gRNA
uugacaugguucguauagaa

SEQ ID NO: 133621 - RNA, 20 nt, Artificial Sequence
  mmSKRIPTE0004400_Cd300a_8
  gRNA
ucuuugcacccccggcucug

SEQ ID NO: 133622 - RNA, 20 nt, Artificial Sequence
  mmSKRIPTE0004401_Cd300a_9
  gRNA
gggaauagucauguucacgg

SEQ ID NO: 133623 - RNA, 20 nt, Artificial Sequence
  mmSKRIPTE0004402_Lgals3_1
  gRNA
aaggcgguagaccagcgccu

SEQ ID NO: 133624 - RNA, 20 nt, Artificial Sequence
  mmSKRIPTE0004403_Lgals3_2
  gRNA
uuguggcucacucuaacgca

SEQ ID NO: 133625 - RNA, 20 nt, Artificial Sequence
  mmSKRIPTE0004404_Lgals3_3
  gRNA
uuucuccgagaguuacccgc

SEQ ID NO: 133626 - RNA, 20 nt, Artificial Sequence
  mmSKRIPTE0004405_Lgals3_4
  gRNA
cacagcguucucuuaccaag

SEQ ID NO: 133627 - RNA, 20 nt, Artificial Sequence
  mmSKRIPTE0004406_Lgals3_5
  gRNA
acgaagcaggacaauaacug

SEQ ID NO: 133628 - RNA, 20 nt, Artificial Sequence
  mmSKRIPTE0004407_Lgals3_6
  gRNA
aacaacuuccuucuuaccag

SEQ ID NO: 133629 - RNA, 20 nt, Artificial Sequence
  mmSKRIPTE0004408_Lgals3_7
  gRNA
agggguguaauuagucaagu

SEQ ID NO: 133630 - RNA, 20 nt, Artificial Sequence
  mmSKRIPTE0004409_Lgals3_8
  gRNA
ugaucacacuaacaaaugag

SEQ ID NO: 133631 - RNA, 20 nt, Artificial Sequence
  mmSKRIPTE0004410_Lgals3_9
  gRNA
aacucaugcgaguauguaug

SEQ ID NO: 133632 - RNA, 20 nt, Artificial Sequence
  mmSKRIPTE0004411_Trim31_1
  gRNA
aacguaguaugcuauaugug

SEQ ID NO: 133633 - RNA, 20 nt, Artificial Sequence
  mmSKRIPTE0004412_Trim31_2
  gRNA
aguccacucagguguaauug

SEQ ID NO: 133634 - RNA, 20 nt, Artificial Sequence
  mmSKRIPTE0004413_Trim31_3
  gRNA
cggcauucauaucgucugug

SEQ ID NO: 133635 - RNA, 20 nt, Artificial Sequence
  mmSKRIPTE0004414_Trim31_4
  gRNA
caaugggugucaaucaacug

SEQ ID NO: 133636 - RNA, 20 nt, Artificial Sequence
  mmSKRIPTE0004415_Trim31_5
  gRNA
ugugggaggcagaaauccgg

SEQ ID NO: 133637 - RNA, 20 nt, Artificial Sequence
  mmSKRIPTE0004416_Trim31_6
  gRNA
cacuucagaugccuucaucg

SEQ ID NO: 133638 - RNA, 20 nt, Artificial Sequence
  mmSKRIPTE0004417_Trim31_7
  gRNA
ggaacuagaaccacacagcg

SEQ ID NO: 133639 - RNA, 20 nt, Artificial Sequence
  mmSKRIPTE0004418_Trim31_8
  gRNA
gguuacagaguuggcgcgag

SEQ ID NO: 133640 - RNA, 20 nt, Artificial Sequence
  mmSKRIPTE0004419_Trim31_9
  gRNA
gagcgcgcagagcuacauau

SEQ ID NO: 133641 - RNA, 20 nt, Artificial Sequence
  mmSKRIPTE0004420_Egr1_1
  gRNA
ucagcgcuagaccaucaagu

SEQ ID NO: 133642 - RNA, 20 nt, Artificial Sequence
  mmSKRIPTE0004421_Egr1_2
  gRNA
uugaaauagaggccgauucg

SEQ ID NO: 133643 - RNA, 20 nt, Artificial Sequence
  mmSKRIPTE0004422_Egr1_3
  gRNA
auauggaaggaccggccggg

SEQ ID NO: 133644 - RNA, 20 nt, Artificial Sequence
  mmSKRIPTE0004423_Egr1_4
  gRNA
cucacgaguagaaggaccgu

SEQ ID NO: 133645 - RNA, 20 nt, Artificial Sequence
  mmSKRIPTE0004424_Egr1_5
  gRNA
uacugagggcacacucgccg

SEQ ID NO: 133646 - RNA, 20 nt, Artificial Sequence
  mmSKRIPTE0004425_Egr1_6
  gRNA
gaaugcgcucuauugcccau

SEQ ID NO: 133647 - RNA, 20 nt, Artificial Sequence
  mmSKRIPTE0004426_Egr1_7
  gRNA
gaugaugcugcugagcaacg

SEQ ID NO: 133648 - RNA, 20 nt, Artificial Sequence
  mmSKRIPTE0004427_Egr1_8
  gRNA
cgcagaccaccgcuuaccug

SEQ ID NO: 133649 - RNA, 20 nt, Artificial Sequence
  mmSKRIPTE0004428_Egr1_9
  gRNA
cgcucaccuuagccuuaagg

SEQ ID NO: 133650 - RNA, 20 nt, Artificial Sequence
  mmSKRIPTE0004429_Il33_1
  gRNA
aguagcccgugguuaucaug

SEQ ID NO: 133651 - RNA, 20 nt, Artificial Sequence
  mmSKRIPTE0004430_Il33_2
  gRNA
acuguguuagcucuccaccg

SEQ ID NO: 133652 - RNA, 20 nt, Artificial Sequence
  mmSKRIPTE0004431_Il33_3
  gRNA
uacagccguacgauccuaca

SEQ ID NO: 133653 - RNA, 20 nt, Artificial Sequence
  mmSKRIPTE0004432_Il33_4
  gRNA
uuugaccaccauauccguaa

SEQ ID NO: 133654 - RNA, 20 nt, Artificial Sequence
  mmSKRIPTE0004433_Il33_5
  gRNA
caaugauuucaaucacgggu

SEQ ID NO: 133655 - RNA, 20 nt, Artificial Sequence
  mmSKRIPTE0004434_Il33_6
  gRNA
uagcucuuaucuuccagucg

SEQ ID NO: 133656 - RNA, 20 nt, Artificial Sequence
  mmSKRIPTE0004435_Il33_7
  gRNA
uugucaacaaugaugcacug

SEQ ID NO: 133657 - RNA, 20 nt, Artificial Sequence
  mmSKRIPTE0004436_Il33_8
  gRNA
gaucccauuagaccauuggg

SEQ ID NO: 133658 - RNA, 20 nt, Artificial Sequence
  mmSKRIPTE0004437_Il33_9
  gRNA
agauauaugacuuacggcgu

SEQ ID NO: 133659 - RNA, 20 nt, Artificial Sequence
  mmSKRIPTE0004438_Grem1_1
  gRNA
caaacugaguaauucgacac

SEQ ID NO: 133660 - RNA, 20 nt, Artificial Sequence
  mmSKRIPTE0004439_Grem1_2
  gRNA
aaucgcaccgcauacacugu

SEQ ID NO: 133661 - RNA, 20 nt, Artificial Sequence
  mmSKRIPTE0004440_Grem1_3
  gRNA
agacaaaagacuuacacccg

SEQ ID NO: 133662 - RNA, 20 nt, Artificial Sequence
  mmSKRIPTE0004441_Grem1_4
  gRNA
uuugacuuaauccaagucga

SEQ ID NO: 133663 - RNA, 20 nt, Artificial Sequence
  mmSKRIPTE0004442_Grem1_5
  gRNA
ccuacuuggcuuaaaccuag

SEQ ID NO: 133664 - RNA, 20 nt, Artificial Sequence
  mmSKRIPTE0004443_Grem1_6
  gRNA
ucgagaugguaugaacccug

SEQ ID NO: 133665 - RNA, 20 nt, Artificial Sequence
  mmSKRIPTE0004444_Grem1_7
  gRNA
cgagccacuugggcucgacg

SEQ ID NO: 133666 - RNA, 20 nt, Artificial Sequence
  mmSKRIPTE0004445_Grem1_8
  gRNA
ccccaggcacauccgaaagg

SEQ ID NO: 133667 - RNA, 20 nt, Artificial Sequence
  mmSKRIPTE0004446_Grem1_9
  gRNA
gguucuucgcuguggacgag

SEQ ID NO: 133668 - RNA, 20 nt, Artificial Sequence
  mmSKRIPTE0004447_Ptpro_1
  gRNA
aaugaacaucaaugcugucg

SEQ ID NO: 133669 - RNA, 20 nt, Artificial Sequence
  mmSKRIPTE0004448_Ptpro_2
  gRNA
gacgucagugacccugcugu

SEQ ID NO: 133670 - RNA, 20 nt, Artificial Sequence
  mmSKRIPTE0004449_Ptpro_3
  gRNA
gugagcugacaagaacggag

SEQ ID NO: 133671 - RNA, 20 nt, Artificial Sequence
  mmSKRIPTE0004450_Ptpro_4
  gRNA
gaggagaugguuaacacacc

SEQ ID NO: 133672 - RNA, 20 nt, Artificial Sequence
  mmSKRIPTE0004451_Ptpro_5
  gRNA
acugcagacggcaaucaggg

SEQ ID NO: 133673 - RNA, 20 nt, Artificial Sequence
  mmSKRIPTE0004452_Ptpro_6
  gRNA
gcuuugaccuuuaaaagacg

SEQ ID NO: 133674 - RNA, 20 nt, Artificial Sequence
  mmSKRIPTE0004453_Ptpro_7
  gRNA
cuguagucuagagcaacacg

SEQ ID NO: 133675 - RNA, 20 nt, Artificial Sequence
  mmSKRIPTE0004454_Ptpro_8
  gRNA
ugaauuacuaacccucacca

SEQ ID NO: 133676 - RNA, 20 nt, Artificial Sequence
  mmSKRIPTE0004455_Ptpro_9
  gRNA
gcagggugcucguuaagcua

SEQ ID NO: 133677 - RNA, 20 nt, Artificial Sequence
  mmSKRIPTE0004456_Nlrp10_1
  gRNA
cugcaaagcuggaggccgcg

SEQ ID NO: 133678 - RNA, 20 nt, Artificial Sequence
  mmSKRIPTE0004457_Nlrp10_2
  gRNA
ccuacgguuucuaacccccg

SEQ ID NO: 133679 - RNA, 20 nt, Artificial Sequence
  mmSKRIPTE0004458_Nlrp10_3
  gRNA
aagcagcuuuaguagcggga

SEQ ID NO: 133680 - RNA, 20 nt, Artificial Sequence
  mmSKRIPTE0004459_Nlrp10_4
  gRNA
acugcaucgacuaccgagcg

SEQ ID NO: 133681 - RNA, 20 nt, Artificial Sequence
  mmSKRIPTE0004460_Nlrp10_5
  gRNA
uucagauccugccuuaccga

SEQ ID NO: 133682 - RNA, 20 nt, Artificial Sequence
  mmSKRIPTE0004461_Nlrp10_6
  gRNA
agauacugagcaccuacuag

SEQ ID NO: 133683 - RNA, 20 nt, Artificial Sequence
  mmSKRIPTE0004462_Nlrp10_7
  gRNA
ccgcccauaguggugaugca

SEQ ID NO: 133684 - RNA, 20 nt, Artificial Sequence
  mmSKRIPTE0004463_Nlrp10_8
  gRNA
accuaugggaucgacucaug

SEQ ID NO: 133685 - RNA, 20 nt, Artificial Sequence
  mmSKRIPTE0004464_Nlrp10_9
  gRNA
uuggauguuagcguagaaug

SEQ ID NO: 133686 - RNA, 20 nt, Artificial Sequence
  mmSKRIPTE0004465_Fgf3_1
  gRNA
cguuuacgagcaccucggcg

SEQ ID NO: 133687 - RNA, 20 nt, Artificial Sequence
  mmSKRIPTE0004466_Fgf3_2
  gRNA
ccauucaccgacacguacca

SEQ ID NO: 133688 - RNA, 20 nt, Artificial Sequence
  mmSKRIPTE0004467_Fgf3_3
  gRNA
ucaguccgaagacgccgccg

SEQ ID NO: 133689 - RNA, 20 nt, Artificial Sequence
  mmSKRIPTE0004468_Fgf3_4
  gRNA
gauuaaggucucccgcacag

SEQ ID NO: 133690 - RNA, 20 nt, Artificial Sequence
  mmSKRIPTE0004469_Fgf3_5
  gRNA
aacccagcuggccaacuacg

SEQ ID NO: 133691 - RNA, 20 nt, Artificial Sequence
  mmSKRIPTE0004470_Fgf3_6
  gRNA
uguaccgcacaggguccagu

SEQ ID NO: 133692 - RNA, 20 nt, Artificial Sequence
  mmSKRIPTE0004471_Fgf3_7
  gRNA
gucugguuggaaguccuggu

SEQ ID NO: 133693 - RNA, 20 nt, Artificial Sequence
  mmSKRIPTE0004472_Fgf3_8
  gRNA
ugccucuaucuaggacgugg

SEQ ID NO: 133694 - RNA, 20 nt, Artificial Sequence
  mmSKRIPTE0004473_Fgf3_9
  gRNA
ugguagcgcaguagagcuug

SEQ ID NO: 133695 - RNA, 20 nt, Artificial Sequence
  mmSKRIPTE0004474_Adam9_1
  gRNA
ccacgcaggugggaucaaug

SEQ ID NO: 133696 - RNA, 20 nt, Artificial Sequence
  mmSKRIPTE0004475_Adam9_2
  gRNA
agugcacacucuaugguacg

SEQ ID NO: 133697 - RNA, 20 nt, Artificial Sequence
  mmSKRIPTE0004476_Adam9_3
  gRNA
gauucgcuuagcaaacuacc

SEQ ID NO: 133698 - RNA, 20 nt, Artificial Sequence
  mmSKRIPTE0004477_Adam9_4
  gRNA
gcucugaaucaacuccggaa

SEQ ID NO: 133699 - RNA, 20 nt, Artificial Sequence
  mmSKRIPTE0004478_Adam9_5
  gRNA
uccugucggagcuaaguacg

SEQ ID NO: 133700 - RNA, 20 nt, Artificial Sequence
  mmSKRIPTE0004479_Adam9_6
  gRNA
augucguacugaaaagacga

SEQ ID NO: 133701 - RNA, 20 nt, Artificial Sequence
  mmSKRIPTE0004480_Adam9_7
  gRNA
caaaugagccgaucccaaug

SEQ ID NO: 133702 - RNA, 20 nt, Artificial Sequence
  mmSKRIPTE0004481_Adam9_8
  gRNA
ucauccuugcaaccccgcgg

SEQ ID NO: 133703 - RNA, 20 nt, Artificial Sequence
  mmSKRIPTE0004482_Adam9_9
  gRNA
agucgaggcaccaaaugcug

SEQ ID NO: 133704 - RNA, 20 nt, Artificial Sequence
  mmSKRIPTE0004483_Cyld_1
  gRNA
acuacacucagauaacgcug

SEQ ID NO: 133705 - RNA, 20 nt, Artificial Sequence
  mmSKRIPTE0004484_Cyld_2
  gRNA
gagcuaauaccauguugcaa

SEQ ID NO: 133706 - RNA, 20 nt, Artificial Sequence
  mmSKRIPTE0004485_Cyld_3
  gRNA
cggauaaccccauagaacgg

SEQ ID NO: 133707 - RNA, 20 nt, Artificial Sequence
  mmSKRIPTE0004486_Cyld_4
  gRNA
acgauccggacaucucagcu

SEQ ID NO: 133708 - RNA, 20 nt, Artificial Sequence
  mmSKRIPTE0004487_Cyld_5
  gRNA
gaggaccuuuauuagcggag

SEQ ID NO: 133709 - RNA, 20 nt, Artificial Sequence
  mmSKRIPTE0004488_Cyld_6
  gRNA
auugcaguaacaugcugacg

SEQ ID NO: 133710 - RNA, 20 nt, Artificial Sequence
  mmSKRIPTE0004489_Cyld_7
  gRNA
auaaccagguuauccgcagu

SEQ ID NO: 133711 - RNA, 20 nt, Artificial Sequence
  mmSKRIPTE0004490_Cyld_8
  gRNA
guacauccaagaccguucug

SEQ ID NO: 133712 - RNA, 20 nt, Artificial Sequence
  mmSKRIPTE0004491_Cyld_9
  gRNA
gccaccccaugaauugucag

SEQ ID NO: 133713 - RNA, 20 nt, Artificial Sequence
  mmSKRIPTE0004492_Sin3a_1
  gRNA
aaucggaggacuacauguac

SEQ ID NO: 133714 - RNA, 20 nt, Artificial Sequence
  mmSKRIPTE0004493_Sin3a_2
  gRNA
ucaucacaccagcgaacucg

SEQ ID NO: 133715 - RNA, 20 nt, Artificial Sequence
  mmSKRIPTE0004494_Sin3a_3
  gRNA
uaguaguggucucuuaaucg

SEQ ID NO: 133716 - RNA, 20 nt, Artificial Sequence
  mmSKRIPTE0004495_Sin3a_4
  gRNA
cugauaucaucgauggccug

SEQ ID NO: 133717 - RNA, 20 nt, Artificial Sequence
  mmSKRIPTE0004496_Sin3a_5
  gRNA
agagcccagucguuuacaag

SEQ ID NO: 133718 - RNA, 20 nt, Artificial Sequence
  mmSKRIPTE0004497_Sin3a_6
  gRNA
uuggcuauucuaaugcagcu

SEQ ID NO: 133719 - RNA, 20 nt, Artificial Sequence
  mmSKRIPTE0004498_Sin3a_7
  gRNA
uacagcaugugggaaucgag

SEQ ID NO: 133720 - RNA, 20 nt, Artificial Sequence
  mmSKRIPTE0004499_Sin3a_8
  gRNA
aauggcagaacauacguuag

SEQ ID NO: 133721 - RNA, 20 nt, Artificial Sequence
  mmSKRIPTE0004500_Sin3a_9
  gRNA
caggcuacagaagagaacgc

SEQ ID NO: 133722 - RNA, 20 nt, Artificial Sequence
  mmSKRIPTE0004501_Rbp1_1
  gRNA
acgaccgcaagugcauggug

SEQ ID NO: 133723 - RNA, 20 nt, Artificial Sequence
  mmSKRIPTE0004502_Rbp1_2
  gRNA
aaaggauucccuagguagcg

SEQ ID NO: 133724 - RNA, 20 nt, Artificial Sequence
  mmSKRIPTE0004503_Rbp1_3
  gRNA
ucagcgugcggaugaucaug

SEQ ID NO: 133725 - RNA, 20 nt, Artificial Sequence
  mmSKRIPTE0004504_Rbp1_4
  gRNA
ggccacguugacgucuacaa

SEQ ID NO: 133726 - RNA, 20 nt, Artificial Sequence
  mmSKRIPTE0004505_Rbp1_5
  gRNA
gaugacgcuagcaaaccuga

SEQ ID NO: 133727 - RNA, 20 nt, Artificial Sequence
  mmSKRIPTE0004506_Rbp1_6
  gRNA
gguguguuuagcauacccug

SEQ ID NO: 133728 - RNA, 20 nt, Artificial Sequence
  mmSKRIPTE0004507_Rbp1_7
  gRNA
ggugaugaacuucaccuggu

SEQ ID NO: 133729 - RNA, 20 nt, Artificial Sequence
  mmSKRIPTE0004508_Rbp1_8
  gRNA
ggugacgcuaaggagucgag

SEQ ID NO: 133730 - RNA, 20 nt, Artificial Sequence
  mmSKRIPTE0004509_Rbp1_9
  gRNA
uguccgauagcucuccccgg

SEQ ID NO: 133731 - RNA, 20 nt, Artificial Sequence
  mmSKRIPTE0004510_Cybb_1
  gRNA
cgacugaguauagagacggc

SEQ ID NO: 133732 - RNA, 20 nt, Artificial Sequence
  mmSKRIPTE0004511_Cybb_2
  gRNA
augccuagggugcaacacga

SEQ ID NO: 133733 - RNA, 20 nt, Artificial Sequence
  mmSKRIPTE0004512_Cybb_3
  gRNA
aaugucccaguaaugcuggu

SEQ ID NO: 133734 - RNA, 20 nt, Artificial Sequence
  mmSKRIPTE0004513_Cybb_4
  gRNA
aauuguacguggacagacug

SEQ ID NO: 133735 - RNA, 20 nt, Artificial Sequence
  mmSKRIPTE0004514_Cybb_5
  gRNA
aggaucccgaauuuaaacua

SEQ ID NO: 133736 - RNA, 20 nt, Artificial Sequence
  mmSKRIPTE0004515_Cybb_6
  gRNA
uuauacucgaaaacuccuug

SEQ ID NO: 133737 - RNA, 20 nt, Artificial Sequence
  mmSKRIPTE0004516_Cybb_7
  gRNA
guuacugguuaaaaagcgca

SEQ ID NO: 133738 - RNA, 20 nt, Artificial Sequence
  mmSKRIPTE0004517_Cybb_8
  gRNA
auccaaaguguugcucgaca

SEQ ID NO: 133739 - RNA, 20 nt, Artificial Sequence
  mmSKRIPTE0004518_Cybb_9
  gRNA
aaaugaaguggacuccacgc

SEQ ID NO: 133740 - RNA, 20 nt, Artificial Sequence
  mmSKRIPTE0004519_Suau1_1
  gRNA
gcgaccgcuucccagucaug

SEQ ID NO: 133741 - RNA, 20 nt, Artificial Sequence
  mmSKRIPTE0004520_Suau1_2
  gRNA
cagaacuguucuguuccgag

SEQ ID NO: 133742 - RNA, 20 nt, Artificial Sequence
  mmSKRIPTE0004521_Suau1_3
  gRNA
uaugccaguugcaugcgcgg

SEQ ID NO: 133743 - RNA, 20 nt, Artificial Sequence
  mmSKRIPTE0004522_Suau1_4
  gRNA
cgagcaaagguuaagcggga

SEQ ID NO: 133744 - RNA, 20 nt, Artificial Sequence
  mmSKRIPTE0004523_Suau1_5
  gRNA
aaaggccaaagucggaacug

SEQ ID NO: 133745 - RNA, 20 nt, Artificial Sequence
  mmSKRIPTE0004524_Suau1_6
  gRNA
gcaacuacugaacuucgaga

SEQ ID NO: 133746 - RNA, 20 nt, Artificial Sequence
  mmSKRIPTE0004525_Suau1_7
  gRNA
guggaacggucccagaacgg

SEQ ID NO: 133747 - RNA, 20 nt, Artificial Sequence
  mmSKRIPTE0004526_Suau1_8
  gRNA
agagucccaacagcacccgu

SEQ ID NO: 133748 - RNA, 20 nt, Artificial Sequence
  mmSKRIPTE0004527_Suau1_9
  gRNA
gaggggcagucguuccugag

SEQ ID NO: 133749 - RNA, 20 nt, Artificial Sequence
  mmSKRIPTE0004528_Sgpl1_1
  gRNA
aggcuuauggagaauucacg

SEQ ID NO: 133750 - RNA, 20 nt, Artificial Sequence
  mmSKRIPTE0004529_Sgpl1_2
  gRNA
gagaagguuucugaucacgc

SEQ ID NO: 133751 - RNA, 20 nt, Artificial Sequence
  mmSKRIPTE0004530_Sgpl1_3
  gRNA
ucuaguaucaugguaucacg

SEQ ID NO: 133752 - RNA, 20 nt, Artificial Sequence
  mmSKRIPTE0004531_Sgpl1_4
  gRNA
acaagggucaaaguucagcg

SEQ ID NO: 133753 - RNA, 20 nt, Artificial Sequence
  mmSKRIPTE0004532_Sgpl1_5
  gRNA
ccuucauugcucauacacga

SEQ ID NO: 133754 - RNA, 20 nt, Artificial Sequence
  mmSKRIPTE0004533_Sgpl1_6
  gRNA
auugagcauauccguuccgu

SEQ ID NO: 133755 - RNA, 20 nt, Artificial Sequence
  mmSKRIPTE0004534_Sgpl1_7
  gRNA
gugagucgcucgcagaaccg

SEQ ID NO: 133756 - RNA, 20 nt, Artificial Sequence
  mmSKRIPTE0004535_Sgpl1_8
  gRNA
cucaggagcuguguacaaug

SEQ ID NO: 133757 - RNA, 20 nt, Artificial Sequence
  mmSKRIPTE0004536_Sgpl1_9
  gRNA
acagaaccaucaagguaaug

SEQ ID NO: 133758 - RNA, 20 nt, Artificial Sequence
  mmSKRIPTE0004537_Flot2_1
  gRNA
ugccuaacguaauagcacca

SEQ ID NO: 133759 - RNA, 20 nt, Artificial Sequence
  mmSKRIPTE0004538_Flot2_2
  gRNA
gucaugaucuucaccugucg

SEQ ID NO: 133760 - RNA, 20 nt, Artificial Sequence
  mmSKRIPTE0004539_Flot2_3
  gRNA
agaauauugagacgucggag

SEQ ID NO: 133761 - RNA, 20 nt, Artificial Sequence
  mmSKRIPTE0004540_Flot2_4
  gRNA
ucuacgcucuauccuaggug

SEQ ID NO: 133762 - RNA, 20 nt, Artificial Sequence
  mmSKRIPTE0004541_Flot2_5
  gRNA
cuuucaucguauauucugug

SEQ ID NO: 133763 - RNA, 20 nt, Artificial Sequence
  mmSKRIPTE0004542_Flot2_6
  gRNA
gucucuacguccucacagcg

SEQ ID NO: 133764 - RNA, 20 nt, Artificial Sequence
  mmSKRIPTE0004543_Flot2_7
  gRNA
uguccccugcaccaucacgg

SEQ ID NO: 133765 - RNA, 20 nt, Artificial Sequence
  mmSKRIPTE0004544_Flot2_8
  gRNA
gcaagccugagugcacgcaa

SEQ ID NO: 133766 - RNA, 20 nt, Artificial Sequence
  mmSKRIPTE0004545_Flot2_9
  gRNA
ugcccaugcggccaacaucg

SEQ ID NO: 133767 - RNA, 20 nt, Artificial Sequence
  mmSKRIPTE0004546_Ccl1_1
  gRNA
cgccucaacuaacaaaacgu

SEQ ID NO: 133768 - RNA, 20 nt, Artificial Sequence
  mmSKRIPTE0004547_Ccl1_2
  gRNA
aggugaaccccugcuaaccg

SEQ ID NO: 133769 - RNA, 20 nt, Artificial Sequence
  mmSKRIPTE0004548_Ccl1_3
  gRNA
ggaauucuagucuccacggu

SEQ ID NO: 133770 - RNA, 20 nt, Artificial Sequence
  mmSKRIPTE0004549_Ccl1_4
  gRNA
gcauggagaccacaucccga

SEQ ID NO: 133771 - RNA, 20 nt, Artificial Sequence
  mmSKRIPTE0004550_Ccl1_5
  gRNA
auaagcuuccaauguaacac

SEQ ID NO: 133772 - RNA, 20 nt, Artificial Sequence
  mmSKRIPTE0004551_Ccl1_6
  gRNA
agguguagagugacacuagg

SEQ ID NO: 133773 - RNA, 20 nt, Artificial Sequence
  mmSKRIPTE0004552_Ccl1_7
  gRNA
uggcuccaccagacauucgg

SEQ ID NO: 133774 - RNA, 20 nt, Artificial Sequence
  mmSKRIPTE0004553_Ccl1_8
  gRNA
cauagcuuaucacaugacug

SEQ ID NO: 133775 - RNA, 20 nt, Artificial Sequence
  mmSKRIPTE0004554_Ccl1_9
  gRNA
ucaaaacuuauccuauacag

SEQ ID NO: 133776 - RNA, 20 nt, Artificial Sequence
  mmSKRIPTE0004555_Ripor2_1
  gRNA
uguacauggacauccuucgc

SEQ ID NO: 133777 - RNA, 20 nt, Artificial Sequence
  mmSKRIPTE0004556_Ripor2_2
  gRNA
cggagacgcuuaguaccggg

SEQ ID NO: 133778 - RNA, 20 nt, Artificial Sequence
  mmSKRIPTE0004557_Ripor2_3
  gRNA
gcccacccugaguauaacgu

SEQ ID NO: 133779 - RNA, 20 nt, Artificial Sequence
  mmSKRIPTE0004558_Ripor2_4
  gRNA
aaaacaaggaacuuacuacc

SEQ ID NO: 133780 - RNA, 20 nt, Artificial Sequence
  mmSKRIPTE0004559_Ripor2_5
  gRNA
guggagcaguaucauucgga

SEQ ID NO: 133781 - RNA, 20 nt, Artificial Sequence
  mmSKRIPTE0004560_Ripor2_6
  gRNA
aggaggaugugucauaacca

SEQ ID NO: 133782 - RNA, 20 nt, Artificial Sequence
  mmSKRIPTE0004561_Ripor2_7
  gRNA
uagcgaucacccuaauagug

SEQ ID NO: 133783 - RNA, 20 nt, Artificial Sequence
  mmSKRIPTE0004562_Ripor2_8
  gRNA
aaaggugggaaacggcacgu

SEQ ID NO: 133784 - RNA, 20 nt, Artificial Sequence
  mmSKRIPTE0004563_Ripor2_9
  gRNA
cagcccacugaaaccugcga

SEQ ID NO: 133785 - RNA, 20 nt, Artificial Sequence
  mmSKRIPTE0004564_Dapk1_1
  gRNA
cuggcauggcuauuacuccg

SEQ ID NO: 133786 - RNA, 20 nt, Artificial Sequence
  mmSKRIPTE0004565_Dapk1_2
  gRNA
uagaaggagacauuggacgu

SEQ ID NO: 133787 - RNA, 20 nt, Artificial Sequence
  mmSKRIPTE0004566_Dapk1_3
  gRNA
auggauccaccagcaaagcg

SEQ ID NO: 133788 - RNA, 20 nt, Artificial Sequence
  mmSKRIPTE0004567_Dapk1_4
  gRNA
auccacauggccaugccgag

SEQ ID NO: 133789 - RNA, 20 nt, Artificial Sequence
  mmSKRIPTE0004568_Dapk1_5
  gRNA
uuacaguuacucauaaaacg

SEQ ID NO: 133790 - RNA, 20 nt, Artificial Sequence
  mmSKRIPTE0004569_Dapk1_6
  gRNA
ccuccauuacugauugccgc

SEQ ID NO: 133791 - RNA, 20 nt, Artificial Sequence
  mmSKRIPTE0004570_Dapk1_7
  gRNA
ugaugcggacauccgucugu

SEQ ID NO: 133792 - RNA, 20 nt, Artificial Sequence
  mmSKRIPTE0004571_Dapk1_8
  gRNA
aagucuaugaucuugauccg

SEQ ID NO: 133793 - RNA, 20 nt, Artificial Sequence
  mmSKRIPTE0004572_Dapk1_9
  gRNA
gugacucggagcacuucgaa

SEQ ID NO: 133794 - RNA, 20 nt, Artificial Sequence
  mmSKRIPTE0004573_Wnt10b_1
  gRNA
aaggcugucucggaaccgga

SEQ ID NO: 133795 - RNA, 20 nt, Artificial Sequence
  mmSKRIPTE0004574_Wnt10b_2
  gRNA
ccaagaacaggagacccgcg

SEQ ID NO: 133796 - RNA, 20 nt, Artificial Sequence
  mmSKRIPTE0004575_Wnt10b_3
  gRNA
agccucgccuaggcacgacg

SEQ ID NO: 133797 - RNA, 20 nt, Artificial Sequence
  mmSKRIPTE0004576_Wnt10b_4
  gRNA
uuucugucuaggguuuaucg

SEQ ID NO: 133798 - RNA, 20 nt, Artificial Sequence
  mmSKRIPTE0004577_Wnt10b_5
  gRNA
guuguggguaucgauaaaga

SEQ ID NO: 133799 - RNA, 20 nt, Artificial Sequence
  mmSKRIPTE0004578_Wnt10b_6
  gRNA
gcggauccacaacaacaggg

SEQ ID NO: 133800 - RNA, 20 nt, Artificial Sequence
  mmSKRIPTE0004579_Wnt10b_7
  gRNA
caagcgcggugagccugacg

SEQ ID NO: 133801 - RNA, 20 nt, Artificial Sequence
  mmSKRIPTE0004580_Wnt10b_8
  gRNA
aaguaggaaccugagcccga

SEQ ID NO: 133802 - RNA, 20 nt, Artificial Sequence
  mmSKRIPTE0004581_Wnt10b_9
  gRNA
cguuaccaccuacaacguca

SEQ ID NO: 133803 - RNA, 20 nt, Artificial Sequence
  mmSKRIPTE0004582_Txnrd2_1
  gRNA
ugucuggauugccuaccucg

SEQ ID NO: 133804 - RNA, 20 nt, Artificial Sequence
  mmSKRIPTE0004583_Txnrd2_2
  gRNA
gagcacacucgggaucugug

SEQ ID NO: 133805 - RNA, 20 nt, Artificial Sequence
  mmSKRIPTE0004584_Txnrd2_3
  gRNA
uaaccccagaaggccacggu

SEQ ID NO: 133806 - RNA, 20 nt, Artificial Sequence
  mmSKRIPTE0004585_Txnrd2_4
  gRNA
gcugggacuucgaagccuug

SEQ ID NO: 133807 - RNA, 20 nt, Artificial Sequence
  mmSKRIPTE0004586_Txnrd2_5
  gRNA
aagccaugacuccuagacga

SEQ ID NO: 133808 - RNA, 20 nt, Artificial Sequence
  mmSKRIPTE0004587_Txnrd2_6
  gRNA
aggaugcgagaagccuacug

SEQ ID NO: 133809 - RNA, 20 nt, Artificial Sequence
  mmSKRIPTE0004588_Txnrd2_7
  gRNA
uaacaugagaguucucgugg

SEQ ID NO: 133810 - RNA, 20 nt, Artificial Sequence
  mmSKRIPTE0004589_Txnrd2_8
  gRNA
ucuuauuugugcggacagug

SEQ ID NO: 133811 - RNA, 20 nt, Artificial Sequence
  mmSKRIPTE0004590_Txnrd2_9
  gRNA
caguagugacuuaacccucg

SEQ ID NO: 133812 - RNA, 20 nt, Artificial Sequence
  mmSKRIPTE0004591_Sod1_1
  gRNA
ucaggccuauaaaagcuccg

SEQ ID NO: 133813 - RNA, 20 nt, Artificial Sequence
  mmSKRIPTE0004592_Sod1_2
  gRNA
guguaaauacuccugcacca

SEQ ID NO: 133814 - RNA, 20 nt, Artificial Sequence
  mmSKRIPTE0004593_Sod1_3
  gRNA
aaggaccgcgcaaaaaaacg

SEQ ID NO: 133815 - RNA, 20 nt, Artificial Sequence
  mmSKRIPTE0004594_Sod1_4
  gRNA
acggaaccaaucgcuacccg

SEQ ID NO: 133816 - RNA, 20 nt, Artificial Sequence
  mmSKRIPTE0004595_Sod1_5
  gRNA
gcggacugagaaaguucccg

SEQ ID NO: 133817 - RNA, 20 nt, Artificial Sequence
  mmSKRIPTE0004596_Sod1_6
  gRNA
cagaagcuauucuagcacgu

SEQ ID NO: 133818 - RNA, 20 nt, Artificial Sequence
  mmSKRIPTE0004597_Sod1_7
  gRNA
auggggacaauacacaaggu

SEQ ID NO: 133819 - RNA, 20 nt, Artificial Sequence
  mmSKRIPTE0004598_Sod1_8
  gRNA
agcagcacgcucuguaugca

SEQ ID NO: 133820 - RNA, 20 nt, Artificial Sequence
  mmSKRIPTE0004599_Sod1_9
  gRNA
cagugcagcuacuuacacca

SEQ ID NO: 133821 - RNA, 20 nt, Artificial Sequence
  mmSKRIPTE0004600_Cnpy3_1
  gRNA
acgcaaccaauggguucgcu

SEQ ID NO: 133822 - RNA, 20 nt, Artificial Sequence
  mmSKRIPTE0004601_Cnpy3_2
  gRNA
gcggcuugcgaaaccgacca

SEQ ID NO: 133823 - RNA, 20 nt, Artificial Sequence
  mmSKRIPTE0004602_Cnpy3_3
  gRNA
ccguugccgugguuacccag

SEQ ID NO: 133824 - RNA, 20 nt, Artificial Sequence
  mmSKRIPTE0004603_Cnpy3_4
  gRNA
gcugggcaaucgcacccagu

SEQ ID NO: 133825 - RNA, 20 nt, Artificial Sequence
  mmSKRIPTE0004604_Cnpy3_5
  gRNA
uacaccaagucgugagugca

SEQ ID NO: 133826 - RNA, 20 nt, Artificial Sequence
  mmSKRIPTE0004605_Cnpy3_6
  gRNA
uuucgacaaagaccuuguug

SEQ ID NO: 133827 - RNA, 20 nt, Artificial Sequence
  mmSKRIPTE0004606_Cnpy3_7
  gRNA
gguaaagcgaugggaguucg

SEQ ID NO: 133828 - RNA, 20 nt, Artificial Sequence
  mmSKRIPTE0004607_Cnpy3_8
  gRNA
cagccggacccagagcagag

SEQ ID NO: 133829 - RNA, 20 nt, Artificial Sequence
  mmSKRIPTE0004608_Cnpy3_9
  gRNA
acuggaucgugagaugcaag

SEQ ID NO: 133830 - RNA, 20 nt, Artificial Sequence
  mmSKRIPTE0004609_Cd70_1
  gRNA
cccugcaucggacauccccg

SEQ ID NO: 133831 - RNA, 20 nt, Artificial Sequence
  mmSKRIPTE0004610_Cd70_2
  gRNA
agaaggucucaucagcguug

SEQ ID NO: 133832 - RNA, 20 nt, Artificial Sequence
  mmSKRIPTE0004611_Cd70_3
  gRNA
ugaaacccaucagugcggag

SEQ ID NO: 133833 - RNA, 20 nt, Artificial Sequence
  mmSKRIPTE0004612_Cd70_4
  gRNA
aaggaccccacacugcgcug

SEQ ID NO: 133834 - RNA, 20 nt, Artificial Sequence
  mmSKRIPTE0004613_Cd70_5
  gRNA
uauauaguacacauauccgu

SEQ ID NO: 133835 - RNA, 20 nt, Artificial Sequence
  mmSKRIPTE0004614_Cd70_6
  gRNA
aacaggggauaacuuaacug

SEQ ID NO: 133836 - RNA, 20 nt, Artificial Sequence
  mmSKRIPTE0004615_Cd70_7
  gRNA
ucccgcuccagcgaacccag

SEQ ID NO: 133837 - RNA, 20 nt, Artificial Sequence
  mmSKRIPTE0004616_Cd70_8
  gRNA
uugggaagguccuucacaca

SEQ ID NO: 133838 - RNA, 20 nt, Artificial Sequence
  mmSKRIPTE0004617_Cd70_9
  gRNA
cuuuggacaggacuguacag

SEQ ID NO: 133839 - RNA, 20 nt, Artificial Sequence
  mmSKRIPTE0004618_Card9_1
  gRNA
agcccaacuagcauuagccu

SEQ ID NO: 133840 - RNA, 20 nt, Artificial Sequence
  mmSKRIPTE0004619_Card9_2
  gRNA
acagaugcucagccucggcg

SEQ ID NO: 133841 - RNA, 20 nt, Artificial Sequence
  mmSKRIPTE0004620_Card9_3
  gRNA
agcauagcuagcuggccgug

SEQ ID NO: 133842 - RNA, 20 nt, Artificial Sequence
  mmSKRIPTE0004621_Card9_4
  gRNA
agagcuucgagaacuaccgc

SEQ ID NO: 133843 - RNA, 20 nt, Artificial Sequence
  mmSKRIPTE0004622_Card9_5
  gRNA
gcaccugcuccucaucaucg

SEQ ID NO: 133844 - RNA, 20 nt, Artificial Sequence
  mmSKRIPTE0004623_Card9_6
  gRNA
auuauaaccgcagccuacag

SEQ ID NO: 133845 - RNA, 20 nt, Artificial Sequence
  mmSKRIPTE0004624_Card9_7
  gRNA
uccauugagagggaccaggu

SEQ ID NO: 133846 - RNA, 20 nt, Artificial Sequence
  mmSKRIPTE0004625_Card9_8
  gRNA
gaaccgugaccugcagcuug

SEQ ID NO: 133847 - RNA, 20 nt, Artificial Sequence
  mmSKRIPTE0004626_Card9_9
  gRNA
guguacuaucagaggcaugu

SEQ ID NO: 133848 - RNA, 20 nt, Artificial Sequence
  mmSKRIPTE0004627_Pax1_1
  gRNA
augaacgcgggauacugacg

SEQ ID NO: 133849 - RNA, 20 nt, Artificial Sequence
  mmSKRIPTE0004628_Pax1_2
  gRNA
uccaggaugcacacgaucag

SEQ ID NO: 133850 - RNA, 20 nt, Artificial Sequence
  mmSKRIPTE0004629_Pax1_3
  gRNA
gugcccaucuuagugcccgu

SEQ ID NO: 133851 - RNA, 20 nt, Artificial Sequence
  mmSKRIPTE0004630_Pax1_4
  gRNA
accgccacaccagcuccgug

SEQ ID NO: 133852 - RNA, 20 nt, Artificial Sequence
  mmSKRIPTE0004631_Pax1_5
  gRNA
cuccacgauucguaggcgga

SEQ ID NO: 133853 - RNA, 20 nt, Artificial Sequence
  mmSKRIPTE0004632_Pax1_6
  gRNA
ggcucgacuucuucaauccg

SEQ ID NO: 133854 - RNA, 20 nt, Artificial Sequence
  mmSKRIPTE0004633_Pax1_7
  gRNA
uggagcaaacagguuagucg

SEQ ID NO: 133855 - RNA, 20 nt, Artificial Sequence
  mmSKRIPTE0004634_Pax1_8
  gRNA
cgugacuguagagauugacg

SEQ ID NO: 133856 - RNA, 20 nt, Artificial Sequence
  mmSKRIPTE0004635_Pax1_9
  gRNA
aacaccggcggguuacucaa

SEQ ID NO: 133857 - RNA, 20 nt, Artificial Sequence
  mmSKRIPTE0004636_Fgg_1
  gRNA
ucgggguuccgacuacccag

SEQ ID NO: 133858 - RNA, 20 nt, Artificial Sequence
  mmSKRIPTE0004637_Fgg_2
  gRNA
gaggaggugacuccucggug

SEQ ID NO: 133859 - RNA, 20 nt, Artificial Sequence
  mmSKRIPTE0004638_Fgg_3
  gRNA
uuggggaaaagaaucgaacg

SEQ ID NO: 133860 - RNA, 20 nt, Artificial Sequence
  mmSKRIPTE0004639_Fgg_4
  gRNA
uugaguaaguaccaccugca

SEQ ID NO: 133861 - RNA, 20 nt, Artificial Sequence
  mmSKRIPTE0004640_Fgg_5
  gRNA
uaaaacaguauggcuucgga

SEQ ID NO: 133862 - RNA, 20 nt, Artificial Sequence
  mmSKRIPTE0004641_Fgg_6
  gRNA
uuaguguacugugaaaucga

SEQ ID NO: 133863 - RNA, 20 nt, Artificial Sequence
  mmSKRIPTE0004642_Fgg_7
  gRNA
acugaccaacgucgcuccag

SEQ ID NO: 133864 - RNA, 20 nt, Artificial Sequence
  mmSKRIPTE0004643_Fgg_8
  gRNA
cauaccgaaugcuugucucg

SEQ ID NO: 133865 - RNA, 20 nt, Artificial Sequence
  mmSKRIPTE0004644_Fgg_9
  gRNA
cuggaaguaguugcaacacg

SEQ ID NO: 133866 - RNA, 20 nt, Artificial Sequence
  mmSKRIPTE0004645_Ctps_1
  gRNA
uggucaccuacacaaugacc

SEQ ID NO: 133867 - RNA, 20 nt, Artificial Sequence
  mmSKRIPTE0004646_Ctps_2
  gRNA
accgccaccgauuugaggug

SEQ ID NO: 133868 - RNA, 20 nt, Artificial Sequence
  mmSKRIPTE0004647_Ctps_3
  gRNA
ccaccccuucuaagcccgag

SEQ ID NO: 133869 - RNA, 20 nt, Artificial Sequence
  mmSKRIPTE0004648_Ctps_4
  gRNA
cugcacugucacgaagacug

SEQ ID NO: 133870 - RNA, 20 nt, Artificial Sequence
  mmSKRIPTE0004649_Ctps_5
  gRNA
ucgagcaggucuccagcaag

SEQ ID NO: 133871 - RNA, 20 nt, Artificial Sequence
  mmSKRIPTE0004650_Ctps_6
  gRNA
uuaauguugagcuacugggg

SEQ ID NO: 133872 - RNA, 20 nt, Artificial Sequence
  mmSKRIPTE0004651_Ctps_7
  gRNA
caagcuaaccaccauacugu

SEQ ID NO: 133873 - RNA, 20 nt, Artificial Sequence
  mmSKRIPTE0004652_Ctps_8
  gRNA
aucgauguacuagugcacca

SEQ ID NO: 133874 - RNA, 20 nt, Artificial Sequence
  mmSKRIPTE0004653_Ctps_9
  gRNA
acacgugcugcauauaaccg

SEQ ID NO: 133875 - RNA, 20 nt, Artificial Sequence
  mmSKRIPTE0004654_Cdc42_1
  gRNA
acugagauuugguauccucg

SEQ ID NO: 133876 - RNA, 20 nt, Artificial Sequence
  mmSKRIPTE0004655_Cdc42_2
  gRNA
gcauccucgagaaccgagag

SEQ ID NO: 133877 - RNA, 20 nt, Artificial Sequence
  mmSKRIPTE0004656_Cdc42_3
  gRNA
cagaagacgcucccgcaggg

SEQ ID NO: 133878 - RNA, 20 nt, Artificial Sequence
  mmSKRIPTE0004657_Cdc42_4
  gRNA
caccacucaaaaauggccag

SEQ ID NO: 133879 - RNA, 20 nt, Artificial Sequence
  mmSKRIPTE0004658_Cdc42_5
  gRNA
gaaucauccuagaaauugug

SEQ ID NO: 133880 - RNA, 20 nt, Artificial Sequence
  mmSKRIPTE0004659_Cdc42_6
  gRNA
ucaccucagcuucuccgccg

SEQ ID NO: 133881 - RNA, 20 nt, Artificial Sequence
  mmSKRIPTE0004660_Cdc42_7
  gRNA
acuaauuagacaaagccaag

SEQ ID NO: 133882 - RNA, 20 nt, Artificial Sequence
  mmSKRIPTE0004661_Cdc42_8
  gRNA
gaccucucuacaagacagag

SEQ ID NO: 133883 - RNA, 20 nt, Artificial Sequence
  mmSKRIPTE0004662_Cdc42_9
  gRNA
cgccugacgucagcacgcag

SEQ ID NO: 133884 - RNA, 20 nt, Artificial Sequence
  mmSKRIPTE0004663_Slit2_1
  gRNA
uggccuuaauuaucacguag

SEQ ID NO: 133885 - RNA, 20 nt, Artificial Sequence
  mmSKRIPTE0004664_Slit2_2
  gRNA
cgguggguaccauugcaaca

SEQ ID NO: 133886 - RNA, 20 nt, Artificial Sequence
  mmSKRIPTE0004665_Slit2_3
  gRNA
cuacuuagaagcgaacacgg

SEQ ID NO: 133887 - RNA, 20 nt, Artificial Sequence
  mmSKRIPTE0004666_Slit2_4
  gRNA
agcgagagcauaacuaccga

SEQ ID NO: 133888 - RNA, 20 nt, Artificial Sequence
  mmSKRIPTE0004667_Slit2_5
  gRNA
aauccaucaaagguucgugg

SEQ ID NO: 133889 - RNA, 20 nt, Artificial Sequence
  mmSKRIPTE0004668_Slit2_6
  gRNA
cuuugcccaccggaauacac

SEQ ID NO: 133890 - RNA, 20 nt, Artificial Sequence
  mmSKRIPTE0004669_Slit2_7
  gRNA
caugccugggaaaaauaacg

SEQ ID NO: 133891 - RNA, 20 nt, Artificial Sequence
  mmSKRIPTE0004670_Slit2_8
  gRNA
agggaccggcuuaucgagca

SEQ ID NO: 133892 - RNA, 20 nt, Artificial Sequence
  mmSKRIPTE0004671_Slit2_9
  gRNA
ccagcucugauuaaagugug

SEQ ID NO: 133893 - RNA, 20 nt, Artificial Sequence
  mmSKRIPTE0004672_Cxcl10_1
  gRNA
acugcauccauaucgaugac

SEQ ID NO: 133894 - RNA, 20 nt, Artificial Sequence
  mmSKRIPTE0004673_Cxcl10_2
  gRNA
acucagcccuaugauacgau

SEQ ID NO: 133895 - RNA, 20 nt, Artificial Sequence
  mmSKRIPTE0004674_Cxcl10_3
  gRNA
gggaaguccccuguaaaccg

SEQ ID NO: 133896 - RNA, 20 nt, Artificial Sequence
  mmSKRIPTE0004675_Cxcl10_4
  gRNA
guccauccaucgcagcaccg

SEQ ID NO: 133897 - RNA, 20 nt, Artificial Sequence
  mmSKRIPTE0004676_Cxcl10_5
  gRNA
gggguuaucaagauacucag

SEQ ID NO: 133898 - RNA, 20 nt, Artificial Sequence
  mmSKRIPTE0004677_Cxcl10_6
  gRNA
auuuacugugugguuacggg

SEQ ID NO: 133899 - RNA, 20 nt, Artificial Sequence
  mmSKRIPTE0004678_Cxcl10_7
  gRNA
agggaucccucucgcaagga

SEQ ID NO: 133900 - RNA, 20 nt, Artificial Sequence
  mmSKRIPTE0004679_Cxcl10_8
  gRNA
cucacaugaucucaacacgu

SEQ ID NO: 133901 - RNA, 20 nt, Artificial Sequence
  mmSKRIPTE0004680_Cxcl10_9
  gRNA
ccaucccagccacuugagcg

SEQ ID NO: 133902 - RNA, 20 nt, Artificial Sequence
  mmSKRIPTE0004681_Ephb6_1
  gRNA
agacggccccgacaguauug

SEQ ID NO: 133903 - RNA, 20 nt, Artificial Sequence
  mmSKRIPTE0004682_Ephb6_2
  gRNA
cguucgcccagcuagcgcug

SEQ ID NO: 133904 - RNA, 20 nt, Artificial Sequence
  mmSKRIPTE0004683_Ephb6_3
  gRNA
ggagugccgaagagaccgca

SEQ ID NO: 133905 - RNA, 20 nt, Artificial Sequence
  mmSKRIPTE0004684_Ephb6_4
  gRNA
gggccuaggacccaagugcg

SEQ ID NO: 133906 - RNA, 20 nt, Artificial Sequence
  mmSKRIPTE0004685_Ephb6_5
  gRNA
gggcacuagggauaucacgg

SEQ ID NO: 133907 - RNA, 20 nt, Artificial Sequence
  mmSKRIPTE0004686_Ephb6_6
  gRNA
cauuucgacccccgccagag

SEQ ID NO: 133908 - RNA, 20 nt, Artificial Sequence
  mmSKRIPTE0004687_Ephb6_7
  gRNA
ugcuucagguaggguauucg

SEQ ID NO: 133909 - RNA, 20 nt, Artificial Sequence
  mmSKRIPTE0004688_Ephb6_8
  gRNA
uugccucucaggaagcgccg

SEQ ID NO: 133910 - RNA, 20 nt, Artificial Sequence
  mmSKRIPTE0004689_Ephb6_9
  gRNA
agcagagcggcgugacaggg

SEQ ID NO: 133911 - RNA, 20 nt, Artificial Sequence
  mmSKRIPTE0004690_Arhgef7_1
  gRNA
auuguaacaccaccguaccc

SEQ ID NO: 133912 - RNA, 20 nt, Artificial Sequence
  mmSKRIPTE0004691_Arhgef7_2
  gRNA
gagcaguccacuuucucacg

SEQ ID NO: 133913 - RNA, 20 nt, Artificial Sequence
  mmSKRIPTE0004692_Arhgef7_3
  gRNA
ucacuucauccgucuuagca

SEQ ID NO: 133914 - RNA, 20 nt, Artificial Sequence
  mmSKRIPTE0004693_Arhgef7_4
  gRNA
ggugguuggcacaguaagcg

SEQ ID NO: 133915 - RNA, 20 nt, Artificial Sequence
  mmSKRIPTE0004694_Arhgef7_5
  gRNA
cuucugcuccguaaaugacg

SEQ ID NO: 133916 - RNA, 20 nt, Artificial Sequence
  mmSKRIPTE0004695_Arhgef7_6
  gRNA
ccccuaaacaccaacccgag

SEQ ID NO: 133917 - RNA, 20 nt, Artificial Sequence
  mmSKRIPTE0004696_Arhgef7_7
  gRNA
ccucccacuagucaucacug

SEQ ID NO: 133918 - RNA, 20 nt, Artificial Sequence
  mmSKRIPTE0004697_Arhgef7_8
  gRNA
ugucgcaguucaccccgugu

SEQ ID NO: 133919 - RNA, 20 nt, Artificial Sequence
  mmSKRIPTE0004698_Arhgef7_9
  gRNA
aggcacucgcucucguuccg

SEQ ID NO: 133920 - RNA, 20 nt, Artificial Sequence
  mmSKRIPTE0004699_Lrrfip2_1
  gRNA
cuugcgguaucaucaucgau

SEQ ID NO: 133921 - RNA, 20 nt, Artificial Sequence
  mmSKRIPTE0004700_Lrrfip2_2
  gRNA
acagugauguacgagaugag

SEQ ID NO: 133922 - RNA, 20 nt, Artificial Sequence
  mmSKRIPTE0004701_Lrrfip2_3
  gRNA
aaggcugcaggaauuucgag

SEQ ID NO: 133923 - RNA, 20 nt, Artificial Sequence
  mmSKRIPTE0004702_Lrrfip2_4
  gRNA
uacccgcaguucacucagug

SEQ ID NO: 133924 - RNA, 20 nt, Artificial Sequence
  mmSKRIPTE0004703_Lrrfip2_5
  gRNA
cucagccgcuuacauccaag

SEQ ID NO: 133925 - RNA, 20 nt, Artificial Sequence
  mmSKRIPTE0004704_Lrrfip2_6
  gRNA
aguggcgcgauaaagagccu

SEQ ID NO: 133926 - RNA, 20 nt, Artificial Sequence
  mmSKRIPTE0004705_Lrrfip2_7
  gRNA
guagaagggcgguacaugca

SEQ ID NO: 133927 - RNA, 20 nt, Artificial Sequence
  mmSKRIPTE0004706_Lrrfip2_8
  gRNA
uaggagcuaaauauguccca

SEQ ID NO: 133928 - RNA, 20 nt, Artificial Sequence
  mmSKRIPTE0004707_Lrrfip2_9
  gRNA
agcaguggagucuucaugag

SEQ ID NO: 133929 - RNA, 20 nt, Artificial Sequence
  mmSKRIPTE0004708_Ppp2r3c_1
  gRNA
cuacgauguaauagacgcag

SEQ ID NO: 133930 - RNA, 20 nt, Artificial Sequence
  mmSKRIPTE0004709_Ppp2r3c_2
  gRNA
cccaagcgaagaagucacgc

SEQ ID NO: 133931 - RNA, 20 nt, Artificial Sequence
  mmSKRIPTE0004710_Ppp2r3c_3
  gRNA
cuuggcgaagucugacgucg

SEQ ID NO: 133932 - RNA, 20 nt, Artificial Sequence
  mmSKRIPTE0004711_Ppp2r3c_4
  gRNA
aguauacgauuaggggacgu

SEQ ID NO: 133933 - RNA, 20 nt, Artificial Sequence
  mmSKRIPTE0004712_Ppp2r3c_5
  gRNA
cuuacccuguaauaaaaccg

SEQ ID NO: 133934 - RNA, 20 nt, Artificial Sequence
  mmSKRIPTE0004713_Ppp2r3c_6
  gRNA
uuagacacggaacauacuaa

SEQ ID NO: 133935 - RNA, 20 nt, Artificial Sequence
  mmSKRIPTE0004714_Ppp2r3c_7
  gRNA
ggaaagacgugcuucgccgg

SEQ ID NO: 133936 - RNA, 20 nt, Artificial Sequence
  mmSKRIPTE0004715_Ppp2r3c_8
  gRNA
gauaccaccuaugauuggag

SEQ ID NO: 133937 - RNA, 20 nt, Artificial Sequence
  mmSKRIPTE0004716_Ppp2r3c_9
  gRNA
gggcagugugcacgcuacgc

SEQ ID NO: 133938 - RNA, 20 nt, Artificial Sequence
  mmSKRIPTE0004717_Grap2_1
  gRNA
agucguacugcaaggcuuag

SEQ ID NO: 133939 - RNA, 20 nt, Artificial Sequence
  mmSKRIPTE0004718_Grap2_2
  gRNA
uccuugcgauccaguacacg

SEQ ID NO: 133940 - RNA, 20 nt, Artificial Sequence
  mmSKRIPTE0004719_Grap2_3
  gRNA
acacugcggccuuggaagug

SEQ ID NO: 133941 - RNA, 20 nt, Artificial Sequence
  mmSKRIPTE0004720_Grap2_4
  gRNA
uugguacgacuaucacacag

SEQ ID NO: 133942 - RNA, 20 nt, Artificial Sequence
  mmSKRIPTE0004721_Grap2_5
  gRNA
gugucuccggugcaucagcg

SEQ ID NO: 133943 - RNA, 20 nt, Artificial Sequence
  mmSKRIPTE0004722_Grap2_6
  gRNA
ccucacccgaguggaaccgu

SEQ ID NO: 133944 - RNA, 20 nt, Artificial Sequence
  mmSKRIPTE0004723_Grap2_7
  gRNA
cggaggcauagguuguuagg

SEQ ID NO: 133945 - RNA, 20 nt, Artificial Sequence
  mmSKRIPTE0004724_Grap2_8
  gRNA
cucuucuggcaguaacugug

SEQ ID NO: 133946 - RNA, 20 nt, Artificial Sequence
  mmSKRIPTE0004725_Grap2_9
  gRNA
agaacggagcgaugccacag

SEQ ID NO: 133947 - RNA, 20 nt, Artificial Sequence
  mmSKRIPTE0004726_Xrcc6_1
  gRNA
guuagucugacuuucacgcg

SEQ ID NO: 133948 - RNA, 20 nt, Artificial Sequence
  mmSKRIPTE0004727_Xrcc6_2
  gRNA
aggugggcaccacguccacg

SEQ ID NO: 133949 - RNA, 20 nt, Artificial Sequence
  mmSKRIPTE0004728_Xrcc6_3
  gRNA
gacaccaagcggucucuggu

SEQ ID NO: 133950 - RNA, 20 nt, Artificial Sequence
  mmSKRIPTE0004729_Xrcc6_4
  gRNA
aggucgacagcgcugcuccg

SEQ ID NO: 133951 - RNA, 20 nt, Artificial Sequence
  mmSKRIPTE0004730_Xrcc6_5
  gRNA
auuaaaaccagggauagcga

SEQ ID NO: 133952 - RNA, 20 nt, Artificial Sequence
  mmSKRIPTE0004731_Xrcc6_6
  gRNA
uacggggagacguucuuccg

SEQ ID NO: 133953 - RNA, 20 nt, Artificial Sequence
  mmSKRIPTE0004732_Xrcc6_7
  gRNA
acagcacacagcuugaaacg

SEQ ID NO: 133954 - RNA, 20 nt, Artificial Sequence
  mmSKRIPTE0004733_Xrcc6_8
  gRNA
gcuugucaucggcauaaggg

SEQ ID NO: 133955 - RNA, 20 nt, Artificial Sequence
  mmSKRIPTE0004734_Xrcc6_9
  gRNA
aagcacuuccgagacacggu

SEQ ID NO: 133956 - RNA, 20 nt, Artificial Sequence
  mmSKRIPTE0004735_Mirlet7e_1
  gRNA
cacccguagaaccgaccuug

SEQ ID NO: 133957 - RNA, 20 nt, Artificial Sequence
  mmSKRIPTE0004736_Mirlet7e_2
  gRNA
gcgauggugagcccccgaca

SEQ ID NO: 133958 - RNA, 20 nt, Artificial Sequence
  mmSKRIPTE0004737_Mirlet7e_3
  gRNA
aaccuccuaccucagcccgg

SEQ ID NO: 133959 - RNA, 20 nt, Artificial Sequence
  mmSKRIPTE0004738_Mirlet7e_4
  gRNA
gcacacaagcucgugucugu

SEQ ID NO: 133960 - RNA, 20 nt, Artificial Sequence
  mmSKRIPTE0004739_Mirlet7e_5
  gRNA
agaacucuugggcaauggug

SEQ ID NO: 133961 - RNA, 20 nt, Artificial Sequence
  mmSKRIPTE0004740_Mirlet7e_6
  gRNA
acggccuccuagcuuucccc

SEQ ID NO: 133962 - RNA, 20 nt, Artificial Sequence
  mmSKRIPTE0004741_Mirlet7e_7
  gRNA
uugaugggagaccagaagua

SEQ ID NO: 133963 - RNA, 20 nt, Artificial Sequence
  mmSKRIPTE0004742_Mirlet7e_8
  gRNA
auaguugaggaagacacccg

SEQ ID NO: 133964 - RNA, 20 nt, Artificial Sequence
  mmSKRIPTE0004743_Mirlet7e_9
  gRNA
cccguagaaccgaccuugcg

SEQ ID NO: 133965 - RNA, 20 nt, Artificial Sequence
  mmSKRIPTE0004744_Sh2d6_1
  gRNA
gagucaugggccaaucaccg

SEQ ID NO: 133966 - RNA, 20 nt, Artificial Sequence
  mmSKRIPTE0004745_Sh2d6_2
  gRNA
acacgcgugugcacuuaacc

SEQ ID NO: 133967 - RNA, 20 nt, Artificial Sequence
  mmSKRIPTE0004746_Sh2d6_3
  gRNA
gggcuggaaugagcauccga

SEQ ID NO: 133968 - RNA, 20 nt, Artificial Sequence
  mmSKRIPTE0004747_Sh2d6_4
  gRNA
aggaugugcagcgauuucag

SEQ ID NO: 133969 - RNA, 20 nt, Artificial Sequence
  mmSKRIPTE0004748_Sh2d6_5
  gRNA
guuucagucucauagcgugg

SEQ ID NO: 133970 - RNA, 20 nt, Artificial Sequence
  mmSKRIPTE0004749_Sh2d6_6
  gRNA
guuuguaagauuuacucacc

SEQ ID NO: 133971 - RNA, 20 nt, Artificial Sequence
  mmSKRIPTE0004750_Sh2d6_7
  gRNA
uuccacggcuccacauaggg

SEQ ID NO: 133972 - RNA, 20 nt, Artificial Sequence
  mmSKRIPTE0004751_Sh2d6_8
  gRNA
caggguaagucggaaugcug

SEQ ID NO: 133973 - RNA, 20 nt, Artificial Sequence
  mmSKRIPTE0004752_Sh2d6_9
  gRNA
acccccgcucagucaugugg

SEQ ID NO: 133974 - RNA, 20 nt, Artificial Sequence
  mmSKRIPTE0004753_Abl2_1
  gRNA
cgcugcgggauacagguccg

SEQ ID NO: 133975 - RNA, 20 nt, Artificial Sequence
  mmSKRIPTE0004754_Abl2_2
  gRNA
ucuccgggagugcagccgag

SEQ ID NO: 133976 - RNA, 20 nt, Artificial Sequence
  mmSKRIPTE0004755_Abl2_3
  gRNA
uguacugaauacccaccagg

SEQ ID NO: 133977 - RNA, 20 nt, Artificial Sequence
  mmSKRIPTE0004756_Abl2_4
  gRNA
ggagacacgccauagacggu

SEQ ID NO: 133978 - RNA, 20 nt, Artificial Sequence
  mmSKRIPTE0004757_Abl2_5
  gRNA
aggcagguauggaaccacag

SEQ ID NO: 133979 - RNA, 20 nt, Artificial Sequence
  mmSKRIPTE0004758_Abl2_6
  gRNA
acugagguucaaaugcggcu

SEQ ID NO: 133980 - RNA, 20 nt, Artificial Sequence
  mmSKRIPTE0004759_Abl2_7
  gRNA
cggugcuggguagugcagcg

SEQ ID NO: 133981 - RNA, 20 nt, Artificial Sequence
  mmSKRIPTE0004760_Abl2_8
  gRNA
gaauuccagugcuggaucgu

SEQ ID NO: 133982 - RNA, 20 nt, Artificial Sequence
  mmSKRIPTE0004761_Abl2_9
  gRNA
ucucaacacaccugucacgu

SEQ ID NO: 133983 - RNA, 20 nt, Artificial Sequence
  mmSKRIPTE0004762_Tnfsf13_1
  gRNA
gcggugacccaggagcacga

SEQ ID NO: 133984 - RNA, 20 nt, Artificial Sequence
  mmSKRIPTE0004763_Tnfsf13_2
  gRNA
gcacccgccuaugaacaacu

SEQ ID NO: 133985 - RNA, 20 nt, Artificial Sequence
  mmSKRIPTE0004764_Tnfsf13_3
  gRNA
gaugaauggcaugcauaucg

SEQ ID NO: 133986 - RNA, 20 nt, Artificial Sequence
  mmSKRIPTE0004765_Tnfsf13_4
  gRNA
ggucaggugguaucucggga

SEQ ID NO: 133987 - RNA, 20 nt, Artificial Sequence
  mmSKRIPTE0004766_Tnfsf13_5
  gRNA
ggcaaccaguacuuaggcgu

SEQ ID NO: 133988 - RNA, 20 nt, Artificial Sequence
  mmSKRIPTE0004767_Tnfsf13_6
  gRNA
uaagcccugagccugccgug

SEQ ID NO: 133989 - RNA, 20 nt, Artificial Sequence
  mmSKRIPTE0004768_Tnfsf13_7
  gRNA
agcagacucugacgugacag

SEQ ID NO: 133990 - RNA, 20 nt, Artificial Sequence
  mmSKRIPTE0004769_Tnfsf13_8
  gRNA
gccagugagaccgcucacuu

SEQ ID NO: 133991 - RNA, 20 nt, Artificial Sequence
  mmSKRIPTE0004770_Tnfsf13_9
  gRNA
gaaaacccuccuuacagaca

SEQ ID NO: 133992 - RNA, 20 nt, Artificial Sequence
  mmSKRIPTE0004771_Lgals9_1
  gRNA
augucuugccagaugcuacg

SEQ ID NO: 133993 - RNA, 20 nt, Artificial Sequence
  mmSKRIPTE0004772_Lgals9_2
  gRNA
aaauaucuagagauucugcg

SEQ ID NO: 133994 - RNA, 20 nt, Artificial Sequence
  mmSKRIPTE0004773_Lgals9_3
  gRNA
ccuguggggaaacaacggag

SEQ ID NO: 133995 - RNA, 20 nt, Artificial Sequence
  mmSKRIPTE0004774_Lgals9_4
  gRNA
cagagcucaguaacuaaacg

SEQ ID NO: 133996 - RNA, 20 nt, Artificial Sequence
  mmSKRIPTE0004775_Lgals9_5
  gRNA
ucucgggucugcgauuccga

SEQ ID NO: 133997 - RNA, 20 nt, Artificial Sequence
  mmSKRIPTE0004776_Lgals9_6
  gRNA
gauugggccugccucuacga

SEQ ID NO: 133998 - RNA, 20 nt, Artificial Sequence
  mmSKRIPTE0004777_Lgals9_7
  gRNA
agacagcgaugguguccacg

SEQ ID NO: 133999 - RNA, 20 nt, Artificial Sequence
  mmSKRIPTE0004778_Lgals9_8
  gRNA
gaccaggaugcucaggacgu

SEQ ID NO: 134000 - RNA, 20 nt, Artificial Sequence
  mmSKRIPTE0004779_Lgals9_9
  gRNA
acucagaucaacaacuccug

SEQ ID NO: 134001 - RNA, 20 nt, Artificial Sequence
  mmSKRIPTE0004780_Hoxb4_1
  gRNA
aagggcagucugcacaacgu

SEQ ID NO: 134002 - RNA, 20 nt, Artificial Sequence
  mmSKRIPTE0004781_Hoxb4_2
  gRNA
aaaccccaauuacgccggcg

SEQ ID NO: 134003 - RNA, 20 nt, Artificial Sequence
  mmSKRIPTE0004782_Hoxb4_3
  gRNA
auuuacauagggcucccgcg

SEQ ID NO: 134004 - RNA, 20 nt, Artificial Sequence
  mmSKRIPTE0004783_Hoxb4_4
  gRNA
ggguacccacuaggucauag

SEQ ID NO: 134005 - RNA, 20 nt, Artificial Sequence
  mmSKRIPTE0004784_Hoxb4_5
  gRNA
uuacagugaagggaccuccg

SEQ ID NO: 134006 - RNA, 20 nt, Artificial Sequence
  mmSKRIPTE0004785_Hoxb4_6
  gRNA
gugcacugugcagcgcuacg

SEQ ID NO: 134007 - RNA, 20 nt, Artificial Sequence
  mmSKRIPTE0004786_Hoxb4_7
  gRNA
gacgacgggcucuuugcacg

SEQ ID NO: 134008 - RNA, 20 nt, Artificial Sequence
  mmSKRIPTE0004787_Hoxb4_8
  gRNA
ccaagcaggaguucgaacau

SEQ ID NO: 134009 - RNA, 20 nt, Artificial Sequence
  mmSKRIPTE0004788_Hoxb4_9
  gRNA
uucuugugaccaucacaucg

SEQ ID NO: 134010 - RNA, 20 nt, Artificial Sequence
  mmSKRIPTE0004789_Rara_1
  gRNA
ucguacaucucgccccacga

SEQ ID NO: 134011 - RNA, 20 nt, Artificial Sequence
  mmSKRIPTE0004790_Rara_2
  gRNA
acuacgguaugccagccgcg

SEQ ID NO: 134012 - RNA, 20 nt, Artificial Sequence
  mmSKRIPTE0004791_Rara_3
  gRNA
cugcagaaauguuucgacgu

SEQ ID NO: 134013 - RNA, 20 nt, Artificial Sequence
  mmSKRIPTE0004792_Rara_4
  gRNA
cgugugucgagguggucaug

SEQ ID NO: 134014 - RNA, 20 nt, Artificial Sequence
  mmSKRIPTE0004793_Rara_5
  gRNA
aggccauagcaaaagcuuag

SEQ ID NO: 134015 - RNA, 20 nt, Artificial Sequence
  mmSKRIPTE0004794_Rara_6
  gRNA
cgcacccggaaucuaagcca

SEQ ID NO: 134016 - RNA, 20 nt, Artificial Sequence
  mmSKRIPTE0004795_Rara_7
  gRNA
ucgaucguuucgcaccgcug

SEQ ID NO: 134017 - RNA, 20 nt, Artificial Sequence
  mmSKRIPTE0004796_Rara_8
  gRNA
acucggauguccuagcugga

SEQ ID NO: 134018 - RNA, 20 nt, Artificial Sequence
  mmSKRIPTE0004797_Rara_9
  gRNA
cggacucagaugcacaacgc

SEQ ID NO: 134019 - RNA, 20 nt, Artificial Sequence
  mmSKRIPTE0004798_Pik3cg_1
  gRNA
auccuggaggcguaccugcg

SEQ ID NO: 134020 - RNA, 20 nt, Artificial Sequence
  mmSKRIPTE0004799_Pik3cg_2
  gRNA
gagguuuggacguuacccaa

SEQ ID NO: 134021 - RNA, 20 nt, Artificial Sequence
  mmSKRIPTE0004800_Pik3cg_3
  gRNA
cgucaguucccaagguaccg

SEQ ID NO: 134022 - RNA, 20 nt, Artificial Sequence
  mmSKRIPTE0004801_Pik3cg_4
  gRNA
ccaguugagaugcaaccgua

SEQ ID NO: 134023 - RNA, 20 nt, Artificial Sequence
  mmSKRIPTE0004802_Pik3cg_5
  gRNA
acaaccggugguucuaagag

SEQ ID NO: 134024 - RNA, 20 nt, Artificial Sequence
  mmSKRIPTE0004803_Pik3cg_6
  gRNA
guucacguaauagagaagcu

SEQ ID NO: 134025 - RNA, 20 nt, Artificial Sequence
  mmSKRIPTE0004804_Pik3cg_7
  gRNA
uguuaauaaacacuuacacc

SEQ ID NO: 134026 - RNA, 20 nt, Artificial Sequence
  mmSKRIPTE0004805_Pik3cg_8
  gRNA
aucauggugacuaaugcugu

SEQ ID NO: 134027 - RNA, 20 nt, Artificial Sequence
  mmSKRIPTE0004806_Pik3cg_9
  gRNA
ucccuguuuagcaggcacug

SEQ ID NO: 134028 - RNA, 20 nt, Artificial Sequence
  mmSKRIPTE0004807_Ahr_1
  gRNA
cugagaugcucccuauacga

SEQ ID NO: 134029 - RNA, 20 nt, Artificial Sequence
  mmSKRIPTE0004808_Ahr_2
  gRNA
augcaccuaugguacaguga

SEQ ID NO: 134030 - RNA, 20 nt, Artificial Sequence
  mmSKRIPTE0004809_Ahr_3
  gRNA
cacguagcaugauuggcgag

SEQ ID NO: 134031 - RNA, 20 nt, Artificial Sequence
  mmSKRIPTE0004810_Ahr_4
  gRNA
cuucccgauaucacacccgg

SEQ ID NO: 134032 - RNA, 20 nt, Artificial Sequence
  mmSKRIPTE0004811_Ahr_5
  gRNA
cgucgguagagcagucccug

SEQ ID NO: 134033 - RNA, 20 nt, Artificial Sequence
  mmSKRIPTE0004812_Ahr_6
  gRNA
agcugugcacaagaggaucg

SEQ ID NO: 134034 - RNA, 20 nt, Artificial Sequence
  mmSKRIPTE0004813_Ahr_7
  gRNA
gauaaacucacaguccgcca

SEQ ID NO: 134035 - RNA, 20 nt, Artificial Sequence
  mmSKRIPTE0004814_Ahr_8
  gRNA
caggguugugagcgacgccg

SEQ ID NO: 134036 - RNA, 20 nt, Artificial Sequence
  mmSKRIPTE0004815_Ahr_9
  gRNA
uuagagcaccacuagacuga

SEQ ID NO: 134037 - RNA, 20 nt, Artificial Sequence
  mmSKRIPTE0004816_Rgcc_1
  gRNA
aaagccuaguugaggauacg

SEQ ID NO: 134038 - RNA, 20 nt, Artificial Sequence
  mmSKRIPTE0004817_Rgcc_2
  gRNA
auagcacguuaucaaaggcg

SEQ ID NO: 134039 - RNA, 20 nt, Artificial Sequence
  mmSKRIPTE0004818_Rgcc_3
  gRNA
guucuucagaggccagcgcg

SEQ ID NO: 134040 - RNA, 20 nt, Artificial Sequence
  mmSKRIPTE0004819_Rgcc_4
  gRNA
cgcguagcagagaugcugcg

SEQ ID NO: 134041 - RNA, 20 nt, Artificial Sequence
  mmSKRIPTE0004820_Rgcc_5
  gRNA
gaauaaguuauccccgccag

SEQ ID NO: 134042 - RNA, 20 nt, Artificial Sequence
  mmSKRIPTE0004821_Rgcc_6
  gRNA
uccaaauaggcacucaccug

SEQ ID NO: 134043 - RNA, 20 nt, Artificial Sequence
  mmSKRIPTE0004822_Rgcc_7
  gRNA
cuacuccgucuuauagccac

SEQ ID NO: 134044 - RNA, 20 nt, Artificial Sequence
  mmSKRIPTE0004823_Rgcc_8
  gRNA
agucccuggcuucgaucccg

SEQ ID NO: 134045 - RNA, 20 nt, Artificial Sequence
  mmSKRIPTE0004824_Rgcc_9
  gRNA
cuuagcaagugaguacacgc

SEQ ID NO: 134046 - RNA, 20 nt, Artificial Sequence
  mmSKRIPTE0004825_Rtp4_1
  gRNA
aaauccguauuccgggucug

SEQ ID NO: 134047 - RNA, 20 nt, Artificial Sequence
  mmSKRIPTE0004826_Rtp4_2
  gRNA
cccaaguacugaagucaucg

SEQ ID NO: 134048 - RNA, 20 nt, Artificial Sequence
  mmSKRIPTE0004827_Rtp4_3
  gRNA
uuaagccucugcacguagug

SEQ ID NO: 134049 - RNA, 20 nt, Artificial Sequence
  mmSKRIPTE0004828_Rtp4_4
  gRNA
ccggacacuuugaaaucgca

SEQ ID NO: 134050 - RNA, 20 nt, Artificial Sequence
  mmSKRIPTE0004829_Rtp4_5
  gRNA
ucacaauugcgugugucgug

SEQ ID NO: 134051 - RNA, 20 nt, Artificial Sequence
  mmSKRIPTE0004830_Rtp4_6
  gRNA
gugguggcucuauuucacgu

SEQ ID NO: 134052 - RNA, 20 nt, Artificial Sequence
  mmSKRIPTE0004831_Rtp4_7
  gRNA
caaagcggcggccggaguaa

SEQ ID NO: 134053 - RNA, 20 nt, Artificial Sequence
  mmSKRIPTE0004832_Rtp4_8
  gRNA
ugcagagauacuauggacac

SEQ ID NO: 134054 - RNA, 20 nt, Artificial Sequence
  mmSKRIPTE0004833_Rtp4_9
  gRNA
ucaguguagagaacuucaca

SEQ ID NO: 134055 - RNA, 20 nt, Artificial Sequence
  mmSKRIPTE0004834_Parp14_1
  gRNA
gcgugcagaaugcuacggua

SEQ ID NO: 134056 - RNA, 20 nt, Artificial Sequence
  mmSKRIPTE0004835_Parp14_2
  gRNA
acucacaaagagauagacgu

SEQ ID NO: 134057 - RNA, 20 nt, Artificial Sequence
  mmSKRIPTE0004836_Parp14_3
  gRNA
cagccgccacgucuuccaug

SEQ ID NO: 134058 - RNA, 20 nt, Artificial Sequence
  mmSKRIPTE0004837_Parp14_4
  gRNA
gcuaacggauuucaccccaa

SEQ ID NO: 134059 - RNA, 20 nt, Artificial Sequence
  mmSKRIPTE0004838_Parp14_5
  gRNA
cugacuacggcauugaguca

SEQ ID NO: 134060 - RNA, 20 nt, Artificial Sequence
  mmSKRIPTE0004839_Parp14_6
  gRNA
aaaaagcugcaauauaagcg

SEQ ID NO: 134061 - RNA, 20 nt, Artificial Sequence
  mmSKRIPTE0004840_Parp14_7
  gRNA
gaugugaggggaauccuacg

SEQ ID NO: 134062 - RNA, 20 nt, Artificial Sequence
  mmSKRIPTE0004841_Parp14_8
  gRNA
ccaaauaggacagcaccaag

SEQ ID NO: 134063 - RNA, 20 nt, Artificial Sequence
  mmSKRIPTE0004842_Parp14_9
  gRNA
gacgaacaguuugacuccgg

SEQ ID NO: 134064 - RNA, 20 nt, Artificial Sequence
  mmSKRIPTE0004843_Msh6_1
  gRNA
aguuucgugauaccaaacag

SEQ ID NO: 134065 - RNA, 20 nt, Artificial Sequence
  mmSKRIPTE0004844_Msh6_2
  gRNA
guuaccuccuccacugacgu

SEQ ID NO: 134066 - RNA, 20 nt, Artificial Sequence
  mmSKRIPTE0004845_Msh6_3
  gRNA
caaggaucgcauccaccgcg

SEQ ID NO: 134067 - RNA, 20 nt, Artificial Sequence
  mmSKRIPTE0004846_Msh6_4
  gRNA
uaaacggugaagcuauccau

SEQ ID NO: 134068 - RNA, 20 nt, Artificial Sequence
  mmSKRIPTE0004847_Msh6_5
  gRNA
gcaguaaguaguucuuacgg

SEQ ID NO: 134069 - RNA, 20 nt, Artificial Sequence
  mmSKRIPTE0004848_Msh6_6
  gRNA
cccgagcauccguagcccag

SEQ ID NO: 134070 - RNA, 20 nt, Artificial Sequence
  mmSKRIPTE0004849_Msh6_7
  gRNA
uccugguaguuaaagcccag

SEQ ID NO: 134071 - RNA, 20 nt, Artificial Sequence
  mmSKRIPTE0004850_Msh6_8
  gRNA
uuccagauuuaggacgcuag

SEQ ID NO: 134072 - RNA, 20 nt, Artificial Sequence
  mmSKRIPTE0004851_Msh6_9
  gRNA
ccucccgacuuucccgccag

SEQ ID NO: 134073 - RNA, 20 nt, Artificial Sequence
  mmSKRIPTE0004852_Il17b_1
  gRNA
gagaguccuaaaucaaagcg

SEQ ID NO: 134074 - RNA, 20 nt, Artificial Sequence
  mmSKRIPTE0004853_Il17b_2
  gRNA
cuagacuuuaggcauucucg

SEQ ID NO: 134075 - RNA, 20 nt, Artificial Sequence
  mmSKRIPTE0004854_Il17b_3
  gRNA
uggucuccaugacgacacgc

SEQ ID NO: 134076 - RNA, 20 nt, Artificial Sequence
  mmSKRIPTE0004855_Il17b_4
  gRNA
caugugacgacugaaccacg

SEQ ID NO: 134077 - RNA, 20 nt, Artificial Sequence
  mmSKRIPTE0004856_Il17b_5
  gRNA
gacgcgcuaaaauggugucg

SEQ ID NO: 134078 - RNA, 20 nt, Artificial Sequence
  mmSKRIPTE0004857_Il17b_6
  gRNA
uggccgcacagccugguacg

SEQ ID NO: 134079 - RNA, 20 nt, Artificial Sequence
  mmSKRIPTE0004858_Il17b_7
  gRNA
ccaacccaacgccuuacggu

SEQ ID NO: 134080 - RNA, 20 nt, Artificial Sequence
  mmSKRIPTE0004859_Il17b_8
  gRNA
uccuuuaauaaaguccacug

SEQ ID NO: 134081 - RNA, 20 nt, Artificial Sequence
  mmSKRIPTE0004860_Il17b_9
  gRNA
cuaaucgcgcugaucccuug

SEQ ID NO: 134082 - RNA, 20 nt, Artificial Sequence
  mmSKRIPTE0004861_Sdc4_1
  gRNA
cuucaugacuuccgucagag

SEQ ID NO: 134083 - RNA, 20 nt, Artificial Sequence
  mmSKRIPTE0004862_Sdc4_2
  gRNA
aaauacauaccgacucuccg

SEQ ID NO: 134084 - RNA, 20 nt, Artificial Sequence
  mmSKRIPTE0004863_Sdc4_3
  gRNA
ccgaguuauacagccacacg

SEQ ID NO: 134085 - RNA, 20 nt, Artificial Sequence
  mmSKRIPTE0004864_Sdc4_4
  gRNA
gcuuaacccucggugcccgg

SEQ ID NO: 134086 - RNA, 20 nt, Artificial Sequence
  mmSKRIPTE0004865_Sdc4_5
  gRNA
gacuaagaucacagcuagag

SEQ ID NO: 134087 - RNA, 20 nt, Artificial Sequence
  mmSKRIPTE0004866_Sdc4_6
  gRNA
uuguguggcuagugcaaccg

SEQ ID NO: 134088 - RNA, 20 nt, Artificial Sequence
  mmSKRIPTE0004867_Sdc4_7
  gRNA
aggcucauuugggaccagcg

SEQ ID NO: 134089 - RNA, 20 nt, Artificial Sequence
  mmSKRIPTE0004868_Sdc4_8
  gRNA
ccagcuaggacccugcacgg

SEQ ID NO: 134090 - RNA, 20 nt, Artificial Sequence
  mmSKRIPTE0004869_Sdc4_9
  gRNA
ucacagcaguauguauaccc

SEQ ID NO: 134091 - RNA, 20 nt, Artificial Sequence
  mmSKRIPTE0004870_Trim62_1
  gRNA
auauuucucuucucgccaag

SEQ ID NO: 134092 - RNA, 20 nt, Artificial Sequence
  mmSKRIPTE0004871_Trim62_2
  gRNA
agcuuccgggugcauaagcg

SEQ ID NO: 134093 - RNA, 20 nt, Artificial Sequence
  mmSKRIPTE0004872_Trim62_3
  gRNA
cggacgguguugauccgcag

SEQ ID NO: 134094 - RNA, 20 nt, Artificial Sequence
  mmSKRIPTE0004873_Trim62_4
  gRNA
uuuccguugucauugacaag

SEQ ID NO: 134095 - RNA, 20 nt, Artificial Sequence
  mmSKRIPTE0004874_Trim62_5
  gRNA
uuguggguguagguucccgu

SEQ ID NO: 134096 - RNA, 20 nt, Artificial Sequence
  mmSKRIPTE0004875_Trim62_6
  gRNA
acccucuccguccaugcagu

SEQ ID NO: 134097 - RNA, 20 nt, Artificial Sequence
  mmSKRIPTE0004876_Trim62_7
  gRNA
guacccgauaacaaucuccu

SEQ ID NO: 134098 - RNA, 20 nt, Artificial Sequence
  mmSKRIPTE0004877_Trim62_8
  gRNA
acuccgugguugaugcccug

SEQ ID NO: 134099 - RNA, 20 nt, Artificial Sequence
  mmSKRIPTE0004878_Trim62_9
  gRNA
uccuagaccaccuacuggag

SEQ ID NO: 134100 - RNA, 20 nt, Artificial Sequence
  mmSKRIPTE0004879_Pla2g5_1
  gRNA
gagagcauacagaugccucg

SEQ ID NO: 134101 - RNA, 20 nt, Artificial Sequence
  mmSKRIPTE0004880_Pla2g5_2
  gRNA
uggaggaggacucugaaucg

SEQ ID NO: 134102 - RNA, 20 nt, Artificial Sequence
  mmSKRIPTE0004881_Pla2g5_3
  gRNA
cauuccacaaaggcccacug

SEQ ID NO: 134103 - RNA, 20 nt, Artificial Sequence
  mmSKRIPTE0004882_Pla2g5_4
  gRNA
gcaugggcugauuugaaucg

SEQ ID NO: 134104 - RNA, 20 nt, Artificial Sequence
  mmSKRIPTE0004883_Pla2g5_5
  gRNA
aacgaacuuaggucgccuag

SEQ ID NO: 134105 - RNA, 20 nt, Artificial Sequence
  mmSKRIPTE0004884_Pla2g5_6
  gRNA
cauuaugggacugcccaaug

SEQ ID NO: 134106 - RNA, 20 nt, Artificial Sequence
  mmSKRIPTE0004885_Pla2g5_7
  gRNA
ggggagucuaugcagacuag

SEQ ID NO: 134107 - RNA, 20 nt, Artificial Sequence
  mmSKRIPTE0004886_Pla2g5_8
  gRNA
auuccacggaucaagcccug

SEQ ID NO: 134108 - RNA, 20 nt, Artificial Sequence
  mmSKRIPTE0004887_Pla2g5_9
  gRNA
ucccuccagaguccgaggaa

SEQ ID NO: 134109 - RNA, 20 nt, Artificial Sequence
  mmSKRIPTE0004888_Mtor_1
  gRNA
gugcuucgcuaguggcugcg

SEQ ID NO: 134110 - RNA, 20 nt, Artificial Sequence
  mmSKRIPTE0004889_Mtor_2
  gRNA
uuccuuugguucccgcugcg

SEQ ID NO: 134111 - RNA, 20 nt, Artificial Sequence
  mmSKRIPTE0004890_Mtor_3
  gRNA
aaaaucgugauaauaccagu

SEQ ID NO: 134112 - RNA, 20 nt, Artificial Sequence
  mmSKRIPTE0004891_Mtor_4
  gRNA
ugacaacuggaucgcuugag

SEQ ID NO: 134113 - RNA, 20 nt, Artificial Sequence
  mmSKRIPTE0004892_Mtor_5
  gRNA
gcucgcuacugccuuaccag

SEQ ID NO: 134114 - RNA, 20 nt, Artificial Sequence
  mmSKRIPTE0004893_Mtor_6
  gRNA
cuaacaguuguugcuaccag

SEQ ID NO: 134115 - RNA, 20 nt, Artificial Sequence
  mmSKRIPTE0004894_Mtor_7
  gRNA
ucucucacccgguaccacug

SEQ ID NO: 134116 - RNA, 20 nt, Artificial Sequence
  mmSKRIPTE0004895_Mtor_8
  gRNA
uagacaaaacgagcaaccag

SEQ ID NO: 134117 - RNA, 20 nt, Artificial Sequence
  mmSKRIPTE0004896_Mtor_9
  gRNA
agaccuaaaugcuccacgga

SEQ ID NO: 134118 - RNA, 20 nt, Artificial Sequence
  mmSKRIPTE0004897_Txk_1
  gRNA
ucacggagaucgcagaaacg

SEQ ID NO: 134119 - RNA, 20 nt, Artificial Sequence
  mmSKRIPTE0004898_Txk_2
  gRNA
cugugcucccgauaagaacg

SEQ ID NO: 134120 - RNA, 20 nt, Artificial Sequence
  mmSKRIPTE0004899_Txk_3
  gRNA
acgagcugagccgauucgca

SEQ ID NO: 134121 - RNA, 20 nt, Artificial Sequence
  mmSKRIPTE0004900_Txk_4
  gRNA
uuacacugcccagagcaccg

SEQ ID NO: 134122 - RNA, 20 nt, Artificial Sequence
  mmSKRIPTE0004901_Txk_5
  gRNA
gugccauugucaccguggcg

SEQ ID NO: 134123 - RNA, 20 nt, Artificial Sequence
  mmSKRIPTE0004902_Txk_6
  gRNA
aaagaucucagacuucggca

SEQ ID NO: 134124 - RNA, 20 nt, Artificial Sequence
  mmSKRIPTE0004903_Txk_7
  gRNA
ggugcgaggauccccagacg

SEQ ID NO: 134125 - RNA, 20 nt, Artificial Sequence
  mmSKRIPTE0004904_Txk_8
  gRNA
auggacgcagaacuaaaggu

SEQ ID NO: 134126 - RNA, 20 nt, Artificial Sequence
  mmSKRIPTE0004905_Txk_9
  gRNA
cuugcaaaaaaacggucgca

SEQ ID NO: 134127 - RNA, 20 nt, Artificial Sequence
  mmSKRIPTE0004906_Cxcl1_1
  gRNA
gcaguggcgagaccuaccug

SEQ ID NO: 134128 - RNA, 20 nt, Artificial Sequence
  mmSKRIPTE0004907_Cxcl1_2
  gRNA
cacacucaagaauggucgcg

SEQ ID NO: 134129 - RNA, 20 nt, Artificial Sequence
  mmSKRIPTE0004908_Cxcl1_3
  gRNA
guguggauacauuucaucga

SEQ ID NO: 134130 - RNA, 20 nt, Artificial Sequence
  mmSKRIPTE0004909_Cxcl1_4
  gRNA
gcgcugcacagagaagcgag

SEQ ID NO: 134131 - RNA, 20 nt, Artificial Sequence
  mmSKRIPTE0004910_Cxcl1_5
  gRNA
acuucgguuugggugcagug

SEQ ID NO: 134132 - RNA, 20 nt, Artificial Sequence
  mmSKRIPTE0004911_Cxcl1_6
  gRNA
uugauagaauuaacguucag

SEQ ID NO: 134133 - RNA, 20 nt, Artificial Sequence
  mmSKRIPTE0004912_Cxcl1_7
  gRNA
uucccacuaggagaagugug

SEQ ID NO: 134134 - RNA, 20 nt, Artificial Sequence
  mmSKRIPTE0004913_Cxcl1_8
  gRNA
ucgagcauaaaaggggcucg

SEQ ID NO: 134135 - RNA, 20 nt, Artificial Sequence
  mmSKRIPTE0004914_Cxcl1_9
  gRNA
guacccgagacuagagucaa

SEQ ID NO: 134136 - RNA, 20 nt, Artificial Sequence
  mmSKRIPTE0004915_Tgfb1_1
  gRNA
ugaucuguggagucacuacg

SEQ ID NO: 134137 - RNA, 20 nt, Artificial Sequence
  mmSKRIPTE0004916_Tgfb1_2
  gRNA
gaagaggucacauuaagucg

SEQ ID NO: 134138 - RNA, 20 nt, Artificial Sequence
  mmSKRIPTE0004917_Tgfb1_3
  gRNA
gggaucagccccaaacgucg

SEQ ID NO: 134139 - RNA, 20 nt, Artificial Sequence
  mmSKRIPTE0004918_Tgfb1_4
  gRNA
guaaacacugucucucuccg

SEQ ID NO: 134140 - RNA, 20 nt, Artificial Sequence
  mmSKRIPTE0004919_Tgfb1_5
  gRNA
cuuaggaagguggccccccg

SEQ ID NO: 134141 - RNA, 20 nt, Artificial Sequence
  mmSKRIPTE0004920_Tgfb1_6
  gRNA
caacaacggugagcuccgag

SEQ ID NO: 134142 - RNA, 20 nt, Artificial Sequence
  mmSKRIPTE0004921_Tgfb1_7
  gRNA
ggaugaggaagcccccacgu

SEQ ID NO: 134143 - RNA, 20 nt, Artificial Sequence
  mmSKRIPTE0004922_Tgfb1_8
  gRNA
uacugcaagucagagacgug

SEQ ID NO: 134144 - RNA, 20 nt, Artificial Sequence
  mmSKRIPTE0004923_Tgfb1_9
  gRNA
gcuacugccagcagguccga

SEQ ID NO: 134145 - RNA, 20 nt, Artificial Sequence
  mmSKRIPTE0004924_Ido1_1
  gRNA
uguaaguaucuacuauugcg

SEQ ID NO: 134146 - RNA, 20 nt, Artificial Sequence
  mmSKRIPTE0004925_Ido1_2
  gRNA
aacugcagcgcuaaacccug

SEQ ID NO: 134147 - RNA, 20 nt, Artificial Sequence
  mmSKRIPTE0004926_Ido1_3
  gRNA
ggcguauguguggaaccgag

SEQ ID NO: 134148 - RNA, 20 nt, Artificial Sequence
  mmSKRIPTE0004927_Ido1_4
  gRNA
gacaagauagaccguccaug

SEQ ID NO: 134149 - RNA, 20 nt, Artificial Sequence
  mmSKRIPTE0004928_Ido1_5
  gRNA
cucaacacaaagaaucccgg

SEQ ID NO: 134150 - RNA, 20 nt, Artificial Sequence
  mmSKRIPTE0004929_Ido1_6
  gRNA
caaacccgggaccuuccgcg

SEQ ID NO: 134151 - RNA, 20 nt, Artificial Sequence
  mmSKRIPTE0004930_Ido1_7
  gRNA
guauuacccgugagcuugag

SEQ ID NO: 134152 - RNA, 20 nt, Artificial Sequence
  mmSKRIPTE0004931_Ido1_8
  gRNA
uuaaagccacgauugagaug

SEQ ID NO: 134153 - RNA, 20 nt, Artificial Sequence
  mmSKRIPTE0004932_Ido1_9
  gRNA
gauccaucaguacugagacg

SEQ ID NO: 134154 - RNA, 20 nt, Artificial Sequence
  mmSKRIPTE0004933_Mst1_1
  gRNA
aacuauugucguaauccgga

SEQ ID NO: 134155 - RNA, 20 nt, Artificial Sequence
  mmSKRIPTE0004934_Mst1_2
  gRNA
ccgcaagcugaccguccaug

SEQ ID NO: 134156 - RNA, 20 nt, Artificial Sequence
  mmSKRIPTE0004935_Mst1_3
  gRNA
gaauguaacacgaaguaccg

SEQ ID NO: 134157 - RNA, 20 nt, Artificial Sequence
  mmSKRIPTE0004936_Mst1_4
  gRNA
cgaaccucucacaggauacg

SEQ ID NO: 134158 - RNA, 20 nt, Artificial Sequence
  mmSKRIPTE0004937_Mst1_5
  gRNA
aggggugaacucccucguga

SEQ ID NO: 134159 - RNA, 20 nt, Artificial Sequence
  mmSKRIPTE0004938_Mst1_6
  gRNA
uccggcagaaauucucacga

SEQ ID NO: 134160 - RNA, 20 nt, Artificial Sequence
  mmSKRIPTE0004939_Mst1_7
  gRNA
cggugaggauuaccguggcg

SEQ ID NO: 134161 - RNA, 20 nt, Artificial Sequence
  mmSKRIPTE0004940_Mst1_8
  gRNA
caagaguaauaaacuucgug

SEQ ID NO: 134162 - RNA, 20 nt, Artificial Sequence
  mmSKRIPTE0004941_Mst1_9
  gRNA
gcugaguaacaggggccacg

SEQ ID NO: 134163 - RNA, 20 nt, Artificial Sequence
  mmSKRIPTE0004942_Ddx3x_1
  gRNA
aaggguaguaacuagauccg

SEQ ID NO: 134164 - RNA, 20 nt, Artificial Sequence
  mmSKRIPTE0004943_Ddx3x_2
  gRNA
auauaaggucgguggccgcg

SEQ ID NO: 134165 - RNA, 20 nt, Artificial Sequence
  mmSKRIPTE0004944_Ddx3x_3
  gRNA
cacucuaagaacuaccucag

SEQ ID NO: 134166 - RNA, 20 nt, Artificial Sequence
  mmSKRIPTE0004945_Ddx3x_4
  gRNA
aagugaugcagcgacccccg

SEQ ID NO: 134167 - RNA, 20 nt, Artificial Sequence
  mmSKRIPTE0004946_Ddx3x_5
  gRNA
agauacuauaaaucguaggc

SEQ ID NO: 134168 - RNA, 20 nt, Artificial Sequence
  mmSKRIPTE0004947_Ddx3x_6
  gRNA
acuuaaagagcugcgccaca

SEQ ID NO: 134169 - RNA, 20 nt, Artificial Sequence
  mmSKRIPTE0004948_Ddx3x_7
  gRNA
ggucagcuucaucuaacacc

SEQ ID NO: 134170 - RNA, 20 nt, Artificial Sequence
  mmSKRIPTE0004949_Ddx3x_8
  gRNA
ucccaacacugcuuuacacg

SEQ ID NO: 134171 - RNA, 20 nt, Artificial Sequence
  mmSKRIPTE0004950_Ddx3x_9
  gRNA
uccgagucgguauauaaggu

SEQ ID NO: 134172 - RNA, 20 nt, Artificial Sequence
  mmSKRIPTE0004951_Fcgr3_1
  gRNA
uggugacacugaugugcgaa

SEQ ID NO: 134173 - RNA, 20 nt, Artificial Sequence
  mmSKRIPTE0004952_Fcgr3_2
  gRNA
uccuugcuaagacuccaacu

SEQ ID NO: 134174 - RNA, 20 nt, Artificial Sequence
  mmSKRIPTE0004953_Fcgr3_3
  gRNA
auccgguaccaccagacaug

SEQ ID NO: 134175 - RNA, 20 nt, Artificial Sequence
  mmSKRIPTE0004954_Fcgr3_4
  gRNA
gagccuuuguaaagcgacca

SEQ ID NO: 134176 - RNA, 20 nt, Artificial Sequence
  mmSKRIPTE0004955_Fcgr3_5
  gRNA
ggagaaaucuucaaaccccg

SEQ ID NO: 134177 - RNA, 20 nt, Artificial Sequence
  mmSKRIPTE0004956_Fcgr3_6
  gRNA
cugaugagccgccuaaaccc

SEQ ID NO: 134178 - RNA, 20 nt, Artificial Sequence
  mmSKRIPTE0004957_Fcgr3_7
  gRNA
uagcguucuguuguaaacaa

SEQ ID NO: 134179 - RNA, 20 nt, Artificial Sequence
  mmSKRIPTE0004958_Fcgr3_8
  gRNA
aacuggaucagagucugaug

SEQ ID NO: 134180 - RNA, 20 nt, Artificial Sequence
  mmSKRIPTE0004959_Fcgr3_9
  gRNA
gaaauucagaauaaacggug

SEQ ID NO: 134181 - RNA, 20 nt, Artificial Sequence
  mmSKRIPTE0004960_Tnfaip3_1
  gRNA
gugugcaacguaacccggau

SEQ ID NO: 134182 - RNA, 20 nt, Artificial Sequence
  mmSKRIPTE0004961_Tnfaip3_2
  gRNA
guccuccagcgguuuccucg

SEQ ID NO: 134183 - RNA, 20 nt, Artificial Sequence
  mmSKRIPTE0004962_Tnfaip3_3
  gRNA
acacauccagugcucgugag

SEQ ID NO: 134184 - RNA, 20 nt, Artificial Sequence
  mmSKRIPTE0004963_Tnfaip3_4
  gRNA
cucagggaaaaacaggacgu

SEQ ID NO: 134185 - RNA, 20 nt, Artificial Sequence
  mmSKRIPTE0004964_Tnfaip3_5
  gRNA
agacaugccucgaacuacac

SEQ ID NO: 134186 - RNA, 20 nt, Artificial Sequence
  mmSKRIPTE0004965_Tnfaip3_6
  gRNA
gcccugccacaccaaacugu

SEQ ID NO: 134187 - RNA, 20 nt, Artificial Sequence
  mmSKRIPTE0004966_Tnfaip3_7
  gRNA
gggccacagaaccuacucgu

SEQ ID NO: 134188 - RNA, 20 nt, Artificial Sequence
  mmSKRIPTE0004967_Tnfaip3_8
  gRNA
ugaucaggugagucgugccg

SEQ ID NO: 134189 - RNA, 20 nt, Artificial Sequence
  mmSKRIPTE0004968_Tnfaip3_9
  gRNA
gcugucauagccuaggacga

SEQ ID NO: 134190 - RNA, 20 nt, Artificial Sequence
  mmSKRIPTE0004969_Bves_1
  gRNA
ggagugguucaaacaaccga

SEQ ID NO: 134191 - RNA, 20 nt, Artificial Sequence
  mmSKRIPTE0004970_Bves_2
  gRNA
ggccugcaccacuuucugcg

SEQ ID NO: 134192 - RNA, 20 nt, Artificial Sequence
  mmSKRIPTE0004971_Bves_3
  gRNA
ggcaugaguggggacacgcg

SEQ ID NO: 134193 - RNA, 20 nt, Artificial Sequence
  mmSKRIPTE0004972_Bves_4
  gRNA
uuccacggaguccaucccgc

SEQ ID NO: 134194 - RNA, 20 nt, Artificial Sequence
  mmSKRIPTE0004973_Bves_5
  gRNA
gacuaaaauaggcaucccgg

SEQ ID NO: 134195 - RNA, 20 nt, Artificial Sequence
  mmSKRIPTE0004974_Bves_6
  gRNA
ugccaagaugaagccaaucg

SEQ ID NO: 134196 - RNA, 20 nt, Artificial Sequence
  mmSKRIPTE0004975_Bves_7
  gRNA
uguccacuaacuuagaacgu

SEQ ID NO: 134197 - RNA, 20 nt, Artificial Sequence
  mmSKRIPTE0004976_Bves_8
  gRNA
aaccuucuaaacaaauccgg

SEQ ID NO: 134198 - RNA, 20 nt, Artificial Sequence
  mmSKRIPTE0004977_Bves_9
  gRNA
ucgcgcgggaaaguugggca

SEQ ID NO: 134199 - RNA, 20 nt, Artificial Sequence
  mmSKRIPTE0004978_Rel_1
  gRNA
ucaugcggguccaucucgag

SEQ ID NO: 134200 - RNA, 20 nt, Artificial Sequence
  mmSKRIPTE0004979_Rel_2
  gRNA
ugccgugugaacaagaacug

SEQ ID NO: 134201 - RNA, 20 nt, Artificial Sequence
  mmSKRIPTE0004980_Rel_3
  gRNA
auggccucgagugaguaccg

SEQ ID NO: 134202 - RNA, 20 nt, Artificial Sequence
  mmSKRIPTE0004981_Rel_4
  gRNA
aguaagcgcacuggcccgcg

SEQ ID NO: 134203 - RNA, 20 nt, Artificial Sequence
  mmSKRIPTE0004982_Rel_5
  gRNA
acaagcgccuuaucagagug

SEQ ID NO: 134204 - RNA, 20 nt, Artificial Sequence
  mmSKRIPTE0004983_Rel_6
  gRNA
ccggacauacccgucugucc

SEQ ID NO: 134205 - RNA, 20 nt, Artificial Sequence
  mmSKRIPTE0004984_Rel_7
  gRNA
ggugugagccgcaaacccag

SEQ ID NO: 134206 - RNA, 20 nt, Artificial Sequence
  mmSKRIPTE0004985_Rel_8
  gRNA
acugcgaccucaauguggug

SEQ ID NO: 134207 - RNA, 20 nt, Artificial Sequence
  mmSKRIPTE0004986_Rel_9
  gRNA
uucacacgcaaaccccggag

SEQ ID NO: 134208 - RNA, 20 nt, Artificial Sequence
  mmSKRIPTE0004987_Dock2_1
  gRNA
acuagggcagaaucgaggca

SEQ ID NO: 134209 - RNA, 20 nt, Artificial Sequence
  mmSKRIPTE0004988_Dock2_2
  gRNA
acucacgacuagcaaguccc

SEQ ID NO: 134210 - RNA, 20 nt, Artificial Sequence
  mmSKRIPTE0004989_Dock2_3
  gRNA
acuuagaucucggagacucg

SEQ ID NO: 134211 - RNA, 20 nt, Artificial Sequence
  mmSKRIPTE0004990_Dock2_4
  gRNA
gguaugucacuaauaaacag

SEQ ID NO: 134212 - RNA, 20 nt, Artificial Sequence
  mmSKRIPTE0004991_Dock2_5
  gRNA
agcacacugucgguauuggg

SEQ ID NO: 134213 - RNA, 20 nt, Artificial Sequence
  mmSKRIPTE0004992_Dock2_6
  gRNA
gaaccggacagucaucacga

SEQ ID NO: 134214 - RNA, 20 nt, Artificial Sequence
  mmSKRIPTE0004993_Dock2_7
  gRNA
guggccuaagcagugcgaug

SEQ ID NO: 134215 - RNA, 20 nt, Artificial Sequence
  mmSKRIPTE0004994_Dock2_8
  gRNA
acgggagguaaccuguacca

SEQ ID NO: 134216 - RNA, 20 nt, Artificial Sequence
  mmSKRIPTE0004995_Dock2_9
  gRNA
ggaacacuagaccuuccagc

SEQ ID NO: 134217 - RNA, 20 nt, Artificial Sequence
  mmSKRIPTE0004996_Nme1_1
  gRNA
guuccgugcgagcagcugcg

SEQ ID NO: 134218 - RNA, 20 nt, Artificial Sequence
  mmSKRIPTE0004997_Nme1_2
  gRNA
uaaagggugcacucuccgcg

SEQ ID NO: 134219 - RNA, 20 nt, Artificial Sequence
  mmSKRIPTE0004998_Nme1_3
  gRNA
aaugguaaauacugccacgg

SEQ ID NO: 134220 - RNA, 20 nt, Artificial Sequence
  mmSKRIPTE0004999_Nme1_4
  gRNA
ucuaagccugggaccauacg

SEQ ID NO: 134221 - RNA, 20 nt, Artificial Sequence
  mmSKRIPTE0005000_Nme1_5
  gRNA
gucagcuugauacgccacgu

SEQ ID NO: 134222 - RNA, 20 nt, Artificial Sequence
  mmSKRIPTE0005001_Nme1_6
  gRNA
uguuccaauacuaaggacgc

SEQ ID NO: 134223 - RNA, 20 nt, Artificial Sequence
  mmSKRIPTE0005002_Nme1_7
  gRNA
augaacacgauaccaccugc

SEQ ID NO: 134224 - RNA, 20 nt, Artificial Sequence
  mmSKRIPTE0005003_Nme1_8
  gRNA
ucaauucagacccauccgug

SEQ ID NO: 134225 - RNA, 20 nt, Artificial Sequence
  mmSKRIPTE0005004_Nme1_9
  gRNA
ccgacuccccagaagaagcg

SEQ ID NO: 134226 - RNA, 20 nt, Artificial Sequence
  mmSKRIPTE0005005_Nup85_1
  gRNA
cggacguggauuuauagcag

SEQ ID NO: 134227 - RNA, 20 nt, Artificial Sequence
  mmSKRIPTE0005006_Nup85_2
  gRNA
gcacuacugacacuucccca

SEQ ID NO: 134228 - RNA, 20 nt, Artificial Sequence
  mmSKRIPTE0005007_Nup85_3
  gRNA
aacuguaagggcgaucggag

SEQ ID NO: 134229 - RNA, 20 nt, Artificial Sequence
  mmSKRIPTE0005008_Nup85_4
  gRNA
cuaccugucagauacgagug

SEQ ID NO: 134230 - RNA, 20 nt, Artificial Sequence
  mmSKRIPTE0005009_Nup85_5
  gRNA
uaacggugggacuauuaaug

SEQ ID NO: 134231 - RNA, 20 nt, Artificial Sequence
  mmSKRIPTE0005010_Nup85_6
  gRNA
guuguagugaggcugucgga

SEQ ID NO: 134232 - RNA, 20 nt, Artificial Sequence
  mmSKRIPTE0005011_Nup85_7
  gRNA
acguguacacgguacugcuu

SEQ ID NO: 134233 - RNA, 20 nt, Artificial Sequence
  mmSKRIPTE0005012_Nup85_8
  gRNA
agcaucauuggauacgaccu

SEQ ID NO: 134234 - RNA, 20 nt, Artificial Sequence
  mmSKRIPTE0005013_Nup85_9
  gRNA
gcugcuaaagauccagccag

SEQ ID NO: 134235 - RNA, 20 nt, Artificial Sequence
  mmSKRIPTE0005014_Lrrc14_1
  gRNA
aagugacucaagguauaccc

SEQ ID NO: 134236 - RNA, 20 nt, Artificial Sequence
  mmSKRIPTE0005015_Lrrc14_2
  gRNA
acaggcugagcuacguaccg

SEQ ID NO: 134237 - RNA, 20 nt, Artificial Sequence
  mmSKRIPTE0005016_Lrrc14_3
  gRNA
cuuggacggcagguucgacg

SEQ ID NO: 134238 - RNA, 20 nt, Artificial Sequence
  mmSKRIPTE0005017_Lrrc14_4
  gRNA
ucuacccaugcguaacacug

SEQ ID NO: 134239 - RNA, 20 nt, Artificial Sequence
  mmSKRIPTE0005018_Lrrc14_5
  gRNA
auagccuacuuauagacuag

SEQ ID NO: 134240 - RNA, 20 nt, Artificial Sequence
  mmSKRIPTE0005019_Lrrc14_6
  gRNA
ggucuacucggauuuccacg

SEQ ID NO: 134241 - RNA, 20 nt, Artificial Sequence
  mmSKRIPTE0005020_Lrrc14_7
  gRNA
cagaugcucugagccccccg

SEQ ID NO: 134242 - RNA, 20 nt, Artificial Sequence
  mmSKRIPTE0005021_Lrrc14_8
  gRNA
cucacgaaggaauguguacg

SEQ ID NO: 134243 - RNA, 20 nt, Artificial Sequence
  mmSKRIPTE0005022_Lrrc14_9
  gRNA
agaucaaggacagucacgcg

SEQ ID NO: 134244 - RNA, 20 nt, Artificial Sequence
  mmSKRIPTE0005023_Cd200_1
  gRNA
cucuuggaaugcaaacaccg

SEQ ID NO: 134245 - RNA, 20 nt, Artificial Sequence
  mmSKRIPTE0005024_Cd200_2
  gRNA
cuuuggagaagugguauccg

SEQ ID NO: 134246 - RNA, 20 nt, Artificial Sequence
  mmSKRIPTE0005025_Cd200_3
  gRNA
gcgauuccauugcgaaaaca

SEQ ID NO: 134247 - RNA, 20 nt, Artificial Sequence
  mmSKRIPTE0005026_Cd200_4
  gRNA
acgcguguaucuaggguggg

SEQ ID NO: 134248 - RNA, 20 nt, Artificial Sequence
  mmSKRIPTE0005027_Cd200_5
  gRNA
caucagauucaaguagacca

SEQ ID NO: 134249 - RNA, 20 nt, Artificial Sequence
  mmSKRIPTE0005028_Cd200_6
  gRNA
gaaugggcgaucuggagccg

SEQ ID NO: 134250 - RNA, 20 nt, Artificial Sequence
  mmSKRIPTE0005029_Cd200_7
  gRNA
ccgacuagggcucccaucgg

SEQ ID NO: 134251 - RNA, 20 nt, Artificial Sequence
  mmSKRIPTE0005030_Cd200_8
  gRNA
cgucaccgaaaucaggagcg

SEQ ID NO: 134252 - RNA, 20 nt, Artificial Sequence
  mmSKRIPTE0005031_Cd200_9
  gRNA
gaagcacauagagaacggca

SEQ ID NO: 134253 - RNA, 20 nt, Artificial Sequence
  mmSKRIPTE0005032_Trim26_1
  gRNA
cuacgugagaguuaggcuag

SEQ ID NO: 134254 - RNA, 20 nt, Artificial Sequence
  mmSKRIPTE0005033_Trim26_2
  gRNA
uguucagucucgagacgcug

SEQ ID NO: 134255 - RNA, 20 nt, Artificial Sequence
  mmSKRIPTE0005034_Trim26_3
  gRNA
gauacccgcucgauccucug

SEQ ID NO: 134256 - RNA, 20 nt, Artificial Sequence
  mmSKRIPTE0005035_Trim26_4
  gRNA
cuugcucaggaccuaccccg

SEQ ID NO: 134257 - RNA, 20 nt, Artificial Sequence
  mmSKRIPTE0005036_Trim26_5
  gRNA
ggaggucgcucgucgaccug

SEQ ID NO: 134258 - RNA, 20 nt, Artificial Sequence
  mmSKRIPTE0005037_Trim26_6
  gRNA
aggagaacauccgacccgug

SEQ ID NO: 134259 - RNA, 20 nt, Artificial Sequence
  mmSKRIPTE0005038_Trim26_7
  gRNA
ccagaucaucagauguagug

SEQ ID NO: 134260 - RNA, 20 nt, Artificial Sequence
  mmSKRIPTE0005039_Trim26_8
  gRNA
auaucugccuuguuaccuag

SEQ ID NO: 134261 - RNA, 20 nt, Artificial Sequence
  mmSKRIPTE0005040_Trim26_9
  gRNA
uagcuuacaccgguugagug

SEQ ID NO: 134262 - RNA, 20 nt, Artificial Sequence
  mmSKRIPTE0005041_C3_1
  gRNA
ugauggaauaccugaccgug

SEQ ID NO: 134263 - RNA, 20 nt, Artificial Sequence
  mmSKRIPTE0005042_C3_2
  gRNA
aaguaccacuacgcgcguga

SEQ ID NO: 134264 - RNA, 20 nt, Artificial Sequence
  mmSKRIPTE0005043_C3_3
  gRNA
cuugacaggaaugccaucgg

SEQ ID NO: 134265 - RNA, 20 nt, Artificial Sequence
  mmSKRIPTE0005044_C3_4
  gRNA
guagagguuucaagagaccg

SEQ ID NO: 134266 - RNA, 20 nt, Artificial Sequence
  mmSKRIPTE0005045_C3_5
  gRNA
gagauaaccaucucgcaccu

SEQ ID NO: 134267 - RNA, 20 nt, Artificial Sequence
  mmSKRIPTE0005046_C3_6
  gRNA
ugcagaucggaaccgcuggg

SEQ ID NO: 134268 - RNA, 20 nt, Artificial Sequence
  mmSKRIPTE0005047_C3_7
  gRNA
acuggcuggaaucuaugcgu

SEQ ID NO: 134269 - RNA, 20 nt, Artificial Sequence
  mmSKRIPTE0005048_C3_8
  gRNA
cuuauaucggaucuucacug

SEQ ID NO: 134270 - RNA, 20 nt, Artificial Sequence
  mmSKRIPTE0005049_C3_9
  gRNA
gcgcauguucguaaaaggcu

SEQ ID NO: 134271 - RNA, 20 nt, Artificial Sequence
  mmSKRIPTE0005050_Nlrc4_1
  gRNA
acaauacggggaauccggga

SEQ ID NO: 134272 - RNA, 20 nt, Artificial Sequence
  mmSKRIPTE0005051_Nlrc4_2
  gRNA
uucaggaguacacggcaggu

SEQ ID NO: 134273 - RNA, 20 nt, Artificial Sequence
  mmSKRIPTE0005052_Nlrc4_3
  gRNA
ccuucacagaaccuaucaug

SEQ ID NO: 134274 - RNA, 20 nt, Artificial Sequence
  mmSKRIPTE0005053_Nlrc4_4
  gRNA
gauaugccucaggcacuccg

SEQ ID NO: 134275 - RNA, 20 nt, Artificial Sequence
  mmSKRIPTE0005054_Nlrc4_5
  gRNA
ugcagcaguuggauuuagcg

SEQ ID NO: 134276 - RNA, 20 nt, Artificial Sequence
  mmSKRIPTE0005055_Nlrc4_6
  gRNA
cauauggaugaucuuucggg

SEQ ID NO: 134277 - RNA, 20 nt, Artificial Sequence
  mmSKRIPTE0005056_Nlrc4_7
  gRNA
ucuacugagaucuaggaacg

SEQ ID NO: 134278 - RNA, 20 nt, Artificial Sequence
  mmSKRIPTE0005057_Nlrc4_8
  gRNA
gguuugcugauaagaauggu

SEQ ID NO: 134279 - RNA, 20 nt, Artificial Sequence
  mmSKRIPTE0005058_Nlrc4_9
  gRNA
cauagcgauucucugcagca

SEQ ID NO: 134280 - RNA, 20 nt, Artificial Sequence
  mmSKRIPTE0005059_Phpt1_1
  gRNA
cagccacggccaaucccgug

SEQ ID NO: 134281 - RNA, 20 nt, Artificial Sequence
  mmSKRIPTE0005060_Phpt1_2
  gRNA
cuacaucaggaaucugaccg

SEQ ID NO: 134282 - RNA, 20 nt, Artificial Sequence
  mmSKRIPTE0005061_Phpt1_3
  gRNA
cccgacccaggccuaugcgu

SEQ ID NO: 134283 - RNA, 20 nt, Artificial Sequence
  mmSKRIPTE0005062_Phpt1_4
  gRNA
gagugcaaggaaaucgugcg

SEQ ID NO: 134284 - RNA, 20 nt, Artificial Sequence
  mmSKRIPTE0005063_Phpt1_5
  gRNA
agagaccugacuuaguccgg

SEQ ID NO: 134285 - RNA, 20 nt, Artificial Sequence
  mmSKRIPTE0005064_Phpt1_6
  gRNA
acgaccguaacccuagagaa

SEQ ID NO: 134286 - RNA, 20 nt, Artificial Sequence
  mmSKRIPTE0005065_Phpt1_7
  gRNA
cccaguaugauuaggauggu

SEQ ID NO: 134287 - RNA, 20 nt, Artificial Sequence
  mmSKRIPTE0005066_Phpt1_8
  gRNA
ggugucauuuggaaaacgug

SEQ ID NO: 134288 - RNA, 20 nt, Artificial Sequence
  mmSKRIPTE0005067_Phpt1_9
  gRNA
agucccaguuaaaggagccg

SEQ ID NO: 134289 - RNA, 20 nt, Artificial Sequence
  mmSKRIPTE0005068_B2m_1
  gRNA
ggaaaacagaagguacucgu

SEQ ID NO: 134290 - RNA, 20 nt, Artificial Sequence
  mmSKRIPTE0005069_B2m_2
  gRNA
caauccggacucagauccgg

SEQ ID NO: 134291 - RNA, 20 nt, Artificial Sequence
  mmSKRIPTE0005070_B2m_3
  gRNA
gagcccaagaccgucuacug

SEQ ID NO: 134292 - RNA, 20 nt, Artificial Sequence
  mmSKRIPTE0005071_B2m_4
  gRNA
aguauacucacgccacccac

SEQ ID NO: 134293 - RNA, 20 nt, Artificial Sequence
  mmSKRIPTE0005072_B2m_5
  gRNA
cuccucaacuaagggucgag

SEQ ID NO: 134294 - RNA, 20 nt, Artificial Sequence
  mmSKRIPTE0005073_B2m_6
  gRNA
cccgucgggaaggagaacua

SEQ ID NO: 134295 - RNA, 20 nt, Artificial Sequence
  mmSKRIPTE0005074_B2m_7
  gRNA
acagcuuugaggcuacaggg

SEQ ID NO: 134296 - RNA, 20 nt, Artificial Sequence
  mmSKRIPTE0005075_B2m_8
  gRNA
ccaaguaaugagaaguacag

SEQ ID NO: 134297 - RNA, 20 nt, Artificial Sequence
  mmSKRIPTE0005076_B2m_9
  gRNA
aaaauguggguagacuuugg

SEQ ID NO: 134298 - RNA, 20 nt, Artificial Sequence
  mmSKRIPTE0005077_Prex1_1
  gRNA
gaccuucgugcaccccaaag

SEQ ID NO: 134299 - RNA, 20 nt, Artificial Sequence
  mmSKRIPTE0005078_Prex1_2
  gRNA
aaagcucagguagcuaccgu

SEQ ID NO: 134300 - RNA, 20 nt, Artificial Sequence
  mmSKRIPTE0005079_Prex1_3
  gRNA
ccugcccuaauaucgcagag

SEQ ID NO: 134301 - RNA, 20 nt, Artificial Sequence
  mmSKRIPTE0005080_Prex1_4
  gRNA
aaguugcaaugggaauacgg

SEQ ID NO: 134302 - RNA, 20 nt, Artificial Sequence
  mmSKRIPTE0005081_Prex1_5
  gRNA
ugacacaaccaaguccaacg

SEQ ID NO: 134303 - RNA, 20 nt, Artificial Sequence
  mmSKRIPTE0005082_Prex1_6
  gRNA
ucuacucuaaucaggcccag

SEQ ID NO: 134304 - RNA, 20 nt, Artificial Sequence
  mmSKRIPTE0005083_Prex1_7
  gRNA
acuuaccguggugcaccuug

SEQ ID NO: 134305 - RNA, 20 nt, Artificial Sequence
  mmSKRIPTE0005084_Prex1_8
  gRNA
cgagcucugcuaucgccugg

SEQ ID NO: 134306 - RNA, 20 nt, Artificial Sequence
  mmSKRIPTE0005085_Prex1_9
  gRNA
guuguagcgguagucaaggg

SEQ ID NO: 134307 - RNA, 20 nt, Artificial Sequence
  mmSKRIPTE0005086_Lck_1
  gRNA
ucuaugcagacgccucugau

SEQ ID NO: 134308 - RNA, 20 nt, Artificial Sequence
  mmSKRIPTE0005087_Lck_2
  gRNA
accccaucaggguacuacaa

SEQ ID NO: 134309 - RNA, 20 nt, Artificial Sequence
  mmSKRIPTE0005088_Lck_3
  gRNA
uccgggaaaagugauacgag

SEQ ID NO: 134310 - RNA, 20 nt, Artificial Sequence
  mmSKRIPTE0005089_Lck_4
  gRNA
gaugaagucaccuugcagcg

SEQ ID NO: 134311 - RNA, 20 nt, Artificial Sequence
  mmSKRIPTE0005090_Lck_5
  gRNA
cacggucgaaucccuuaccc

SEQ ID NO: 134312 - RNA, 20 nt, Artificial Sequence
  mmSKRIPTE0005091_Lck_6
  gRNA
ugagccguaaggacgccgag

SEQ ID NO: 134313 - RNA, 20 nt, Artificial Sequence
  mmSKRIPTE0005092_Lck_7
  gRNA
uucgcuuucccggaucagga

SEQ ID NO: 134314 - RNA, 20 nt, Artificial Sequence
  mmSKRIPTE0005093_Lck_8
  gRNA
ucucccagguagucccccaa

SEQ ID NO: 134315 - RNA, 20 nt, Artificial Sequence
  mmSKRIPTE0005094_Lck_9
  gRNA
cgugagcaggagaccuccgu

SEQ ID NO: 134316 - RNA, 20 nt, Artificial Sequence
  mmSKRIPTE0005095_Tesc_1
  gRNA
gcucgagcggccucuuauag

SEQ ID NO: 134317 - RNA, 20 nt, Artificial Sequence
  mmSKRIPTE0005096_Tesc_2
  gRNA
cagcugcucuaucugguccg

SEQ ID NO: 134318 - RNA, 20 nt, Artificial Sequence
  mmSKRIPTE0005097_Tesc_3
  gRNA
gcagucacgaaugaucggaa

SEQ ID NO: 134319 - RNA, 20 nt, Artificial Sequence
  mmSKRIPTE0005098_Tesc_4
  gRNA
cuucaguuauccuccucgug

SEQ ID NO: 134320 - RNA, 20 nt, Artificial Sequence
  mmSKRIPTE0005099_Tesc_5
  gRNA
ucagugagcaccuaacagag

SEQ ID NO: 134321 - RNA, 20 nt, Artificial Sequence
  mmSKRIPTE0005100_Tesc_6
  gRNA
aaccggaccagguguacgag

SEQ ID NO: 134322 - RNA, 20 nt, Artificial Sequence
  mmSKRIPTE0005101_Tesc_7
  gRNA
uuguucugaccuccgcacca

SEQ ID NO: 134323 - RNA, 20 nt, Artificial Sequence
  mmSKRIPTE0005102_Tesc_8
  gRNA
cguguggucugugacguaag

SEQ ID NO: 134324 - RNA, 20 nt, Artificial Sequence
  mmSKRIPTE0005103_Tesc_9
  gRNA
uggcugcacgucuuaccgaa

SEQ ID NO: 134325 - RNA, 20 nt, Artificial Sequence
  mmSKRIPTE0005104_Nod1_1
  gRNA
accgugagacggcuaaagca

SEQ ID NO: 134326 - RNA, 20 nt, Artificial Sequence
  mmSKRIPTE0005105_Nod1_2
  gRNA
cugcacguaggguuuccgcc

SEQ ID NO: 134327 - RNA, 20 nt, Artificial Sequence
  mmSKRIPTE0005106_Nod1_3
  gRNA
cacgcauuaagagcauacgc

SEQ ID NO: 134328 - RNA, 20 nt, Artificial Sequence
  mmSKRIPTE0005107_Nod1_4
  gRNA
auaagaucgugacguuccug

SEQ ID NO: 134329 - RNA, 20 nt, Artificial Sequence
  mmSKRIPTE0005108_Nod1_5
  gRNA
uacucacccaacaucaacga

SEQ ID NO: 134330 - RNA, 20 nt, Artificial Sequence
  mmSKRIPTE0005109_Nod1_6
  gRNA
guucgguucuggauucucag

SEQ ID NO: 134331 - RNA, 20 nt, Artificial Sequence
  mmSKRIPTE0005110_Nod1_7
  gRNA
cgucaaccagaucaccgaca

SEQ ID NO: 134332 - RNA, 20 nt, Artificial Sequence
  mmSKRIPTE0005111_Nod1_8
  gRNA
uuggucuguccauuacacaa

SEQ ID NO: 134333 - RNA, 20 nt, Artificial Sequence
  mmSKRIPTE0005112_Nod1_9
  gRNA
cgucugcagggucucagccg

SEQ ID NO: 134334 - RNA, 20 nt, Artificial Sequence
  mmSKRIPTE0005113_Igbp1b_1
  gRNA
aacacuucgagugaggacga

SEQ ID NO: 134335 - RNA, 20 nt, Artificial Sequence
  mmSKRIPTE0005114_Igbp1b_2
  gRNA
aacgacgccaucuugccaga

SEQ ID NO: 134336 - RNA, 20 nt, Artificial Sequence
  mmSKRIPTE0005115_Igbp1b_3
  gRNA
agagcaccggacauuaacua

SEQ ID NO: 134337 - RNA, 20 nt, Artificial Sequence
  mmSKRIPTE0005116_Igbp1b_4
  gRNA
uggaaggacacucauccuag

SEQ ID NO: 134338 - RNA, 20 nt, Artificial Sequence
  mmSKRIPTE0005117_Igbp1b_5
  gRNA
gggcaucagagguggcagcg

SEQ ID NO: 134339 - RNA, 20 nt, Artificial Sequence
  mmSKRIPTE0005118_Igbp1b_6
  gRNA
aguguucucgagcauccugc

SEQ ID NO: 134340 - RNA, 20 nt, Artificial Sequence
  mmSKRIPTE0005119_Igbp1b_7
  gRNA
gucuuaggcuuauagagacc

SEQ ID NO: 134341 - RNA, 20 nt, Artificial Sequence
  mmSKRIPTE0005120_Igbp1b_8
  gRNA
cugcucguaccagucauuca

SEQ ID NO: 134342 - RNA, 20 nt, Artificial Sequence
  mmSKRIPTE0005121_Igbp1b_9
  gRNA
uagguggauuagcaucagcc

SEQ ID NO: 134343 - RNA, 20 nt, Artificial Sequence
  mmSKRIPTE0005122_Relb_1
  gRNA
cacuacaauaugacccccgg

SEQ ID NO: 134344 - RNA, 20 nt, Artificial Sequence
  mmSKRIPTE0005123_Relb_2
  gRNA
guuucccaaccaguaccgag

SEQ ID NO: 134345 - RNA, 20 nt, Artificial Sequence
  mmSKRIPTE0005124_Relb_3
  gRNA
acagaggucgcuaugacagu

SEQ ID NO: 134346 - RNA, 20 nt, Artificial Sequence
  mmSKRIPTE0005125_Relb_4
  gRNA
cuccaagucccaccuuaaug

SEQ ID NO: 134347 - RNA, 20 nt, Artificial Sequence
  mmSKRIPTE0005126_Relb_5
  gRNA
guccaacauagugaagagcg

SEQ ID NO: 134348 - RNA, 20 nt, Artificial Sequence
  mmSKRIPTE0005127_Relb_6
  gRNA
ccaaguuaguucugacuacg

SEQ ID NO: 134349 - RNA, 20 nt, Artificial Sequence
  mmSKRIPTE0005128_Relb_7
  gRNA
ggggcucggauuucgcccug

SEQ ID NO: 134350 - RNA, 20 nt, Artificial Sequence
  mmSKRIPTE0005129_Relb_8
  gRNA
uuugacgugacgucacggag

SEQ ID NO: 134351 - RNA, 20 nt, Artificial Sequence
  mmSKRIPTE0005130_Relb_9
  gRNA
cucagggcgagcgcacacga

SEQ ID NO: 134352 - RNA, 20 nt, Artificial Sequence
  mmSKRIPTE0005131_Cebpa_1
  gRNA
ugcucgcagaugccgcccag

SEQ ID NO: 134353 - RNA, 20 nt, Artificial Sequence
  mmSKRIPTE0005132_Cebpa_2
  gRNA
uaaagccaaacaacgcaacg

SEQ ID NO: 134354 - RNA, 20 nt, Artificial Sequence
  mmSKRIPTE0005133_Cebpa_3
  gRNA
auacacccuuggacaacuag

SEQ ID NO: 134355 - RNA, 20 nt, Artificial Sequence
  mmSKRIPTE0005134_Cebpa_4
  gRNA
agacccguuuggacaccagg

SEQ ID NO: 134356 - RNA, 20 nt, Artificial Sequence
  mmSKRIPTE0005135_Cebpa_5
  gRNA
ggagucggccgacuucuacg

SEQ ID NO: 134357 - RNA, 20 nt, Artificial Sequence
  mmSKRIPTE0005136_Cebpa_6
  gRNA
gcacaaucgauccaucccag

SEQ ID NO: 134358 - RNA, 20 nt, Artificial Sequence
  mmSKRIPTE0005137_Cebpa_7
  gRNA
aggacuaggagauuccggug

SEQ ID NO: 134359 - RNA, 20 nt, Artificial Sequence
  mmSKRIPTE0005138_Cebpa_8
  gRNA
gugcuaguggagagagaucg

SEQ ID NO: 134360 - RNA, 20 nt, Artificial Sequence
  mmSKRIPTE0005139_Cebpa_9
  gRNA
acucggugcgucuaagauga

SEQ ID NO: 134361 - RNA, 20 nt, Artificial Sequence
  mmSKRIPTE0005140_Chrna7_1
  gRNA
uacucggcaggggcaccaug

SEQ ID NO: 134362 - RNA, 20 nt, Artificial Sequence
  mmSKRIPTE0005141_Chrna7_2
  gRNA
cacacagguccauggaucgu

SEQ ID NO: 134363 - RNA, 20 nt, Artificial Sequence
  mmSKRIPTE0005142_Chrna7_3
  gRNA
gcugcacgguaaccucagcg

SEQ ID NO: 134364 - RNA, 20 nt, Artificial Sequence
  mmSKRIPTE0005143_Chrna7_4
  gRNA
uggauguggugagucuggcg

SEQ ID NO: 134365 - RNA, 20 nt, Artificial Sequence
  mmSKRIPTE0005144_Chrna7_5
  gRNA
guagaguguccuacggcgca

SEQ ID NO: 134366 - RNA, 20 nt, Artificial Sequence
  mmSKRIPTE0005145_Chrna7_6
  gRNA
aaaccaugggacuuauggca

SEQ ID NO: 134367 - RNA, 20 nt, Artificial Sequence
  mmSKRIPTE0005146_Chrna7_7
  gRNA
uccuggucugcaacgacaag

SEQ ID NO: 134368 - RNA, 20 nt, Artificial Sequence
  mmSKRIPTE0005147_Chrna7_8
  gRNA
ccauugucaagugaacagca

SEQ ID NO: 134369 - RNA, 20 nt, Artificial Sequence
  mmSKRIPTE0005148_Chrna7_9
  gRNA
gauaucaauaucuuacagag

SEQ ID NO: 134370 - RNA, 20 nt, Artificial Sequence
  mmSKRIPTE0005149_Gab2_1
  gRNA
gcuggcuauggaacgaccag

SEQ ID NO: 134371 - RNA, 20 nt, Artificial Sequence
  mmSKRIPTE0005150_Gab2_2
  gRNA
ucguuguugugggaauacug

SEQ ID NO: 134372 - RNA, 20 nt, Artificial Sequence
  mmSKRIPTE0005151_Gab2_3
  gRNA
acgacgugguguguaccggc

SEQ ID NO: 134373 - RNA, 20 nt, Artificial Sequence
  mmSKRIPTE0005152_Gab2_4
  gRNA
accuacgaguacccggcacg

SEQ ID NO: 134374 - RNA, 20 nt, Artificial Sequence
  mmSKRIPTE0005153_Gab2_5
  gRNA
cgcugguuuauacuucggag

SEQ ID NO: 134375 - RNA, 20 nt, Artificial Sequence
  mmSKRIPTE0005154_Gab2_6
  gRNA
ugcaaguagagauacuccug

SEQ ID NO: 134376 - RNA, 20 nt, Artificial Sequence
  mmSKRIPTE0005155_Gab2_7
  gRNA
ugccgugggauauacucaca

SEQ ID NO: 134377 - RNA, 20 nt, Artificial Sequence
  mmSKRIPTE0005156_Gab2_8
  gRNA
gacaacagccgacuccaucg

SEQ ID NO: 134378 - RNA, 20 nt, Artificial Sequence
  mmSKRIPTE0005157_Gab2_9
  gRNA
aaaugccaucauucuucggg

SEQ ID NO: 134379 - RNA, 20 nt, Artificial Sequence
  mmSKRIPTE0005158_Cd81_1
  gRNA
uuccaugagacgguauagcu

SEQ ID NO: 134380 - RNA, 20 nt, Artificial Sequence
  mmSKRIPTE0005159_Cd81_2
  gRNA
auccugcaucgcgagcagug

SEQ ID NO: 134381 - RNA, 20 nt, Artificial Sequence
  mmSKRIPTE0005160_Cd81_3
  gRNA
aucucccacucggugaaccu

SEQ ID NO: 134382 - RNA, 20 nt, Artificial Sequence
  mmSKRIPTE0005161_Cd81_4
  gRNA
cgggccggagaacugcguug

SEQ ID NO: 134383 - RNA, 20 nt, Artificial Sequence
  mmSKRIPTE0005162_Cd81_5
  gRNA
uagcccaugagguaccaacu

SEQ ID NO: 134384 - RNA, 20 nt, Artificial Sequence
  mmSKRIPTE0005163_Cd81_6
  gRNA
gcucaccuaacucuaaggac

SEQ ID NO: 134385 - RNA, 20 nt, Artificial Sequence
  mmSKRIPTE0005164_Cd81_7
  gRNA
agggugagcagguccaauag

SEQ ID NO: 134386 - RNA, 20 nt, Artificial Sequence
  mmSKRIPTE0005165_Cd81_8
  gRNA
caauggcugcaauuccaaug

SEQ ID NO: 134387 - RNA, 20 nt, Artificial Sequence
  mmSKRIPTE0005166_Cd81_9
  gRNA
ccugacccuuagauccugag

SEQ ID NO: 134388 - RNA, 20 nt, Artificial Sequence
  mmSKRIPTE0005167_Tlr3_1
  gRNA
gaauggucaaguuacgaaga

SEQ ID NO: 134389 - RNA, 20 nt, Artificial Sequence
  mmSKRIPTE0005168_Tlr3_2
  gRNA
gguacugcucauucacaucg

SEQ ID NO: 134390 - RNA, 20 nt, Artificial Sequence
  mmSKRIPTE0005169_Tlr3_3
  gRNA
ggaaauuaacgggaccaccg

SEQ ID NO: 134391 - RNA, 20 nt, Artificial Sequence
  mmSKRIPTE0005170_Tlr3_4
  gRNA
ugagaaauuaucguuuggca

SEQ ID NO: 134392 - RNA, 20 nt, Artificial Sequence
  mmSKRIPTE0005171_Tlr3_5
  gRNA
ucacaaaucgaccuucaggg

SEQ ID NO: 134393 - RNA, 20 nt, Artificial Sequence
  mmSKRIPTE0005172_Tlr3_6
  gRNA
uggacccagcagucacgacg

SEQ ID NO: 134394 - RNA, 20 nt, Artificial Sequence
  mmSKRIPTE0005173_Tlr3_7
  gRNA
cacacccagcuauguacgug

SEQ ID NO: 134395 - RNA, 20 nt, Artificial Sequence
  mmSKRIPTE0005174_Tlr3_8
  gRNA
aucuacaaaguugggaacgg

SEQ ID NO: 134396 - RNA, 20 nt, Artificial Sequence
  mmSKRIPTE0005175_Tlr3_9
  gRNA
gauguaucgaaaagcuucag

SEQ ID NO: 134397 - RNA, 20 nt, Artificial Sequence
  mmSKRIPTE0005176_Il34_1
  gRNA
ucuugggauccuacuugacg

SEQ ID NO: 134398 - RNA, 20 nt, Artificial Sequence
  mmSKRIPTE0005177_Il34_2
  gRNA
gcggguggccaagaacgacg

SEQ ID NO: 134399 - RNA, 20 nt, Artificial Sequence
  mmSKRIPTE0005178_Il34_3
  gRNA
ugccacgugguugauccaug

SEQ ID NO: 134400 - RNA, 20 nt, Artificial Sequence
  mmSKRIPTE0005179_Il34_4
  gRNA
gugauggauguacuucucga

SEQ ID NO: 134401 - RNA, 20 nt, Artificial Sequence
  mmSKRIPTE0005180_Il34_5
  gRNA
ugagcaugugagacacacga

SEQ ID NO: 134402 - RNA, 20 nt, Artificial Sequence
  mmSKRIPTE0005181_Il34_6
  gRNA
cauugcuggagaacguacag

SEQ ID NO: 134403 - RNA, 20 nt, Artificial Sequence
  mmSKRIPTE0005182_Il34_7
  gRNA
agguguacaccaacggccug

SEQ ID NO: 134404 - RNA, 20 nt, Artificial Sequence
  mmSKRIPTE0005183_Il34_8
  gRNA
uugccaaacauugaccagga

SEQ ID NO: 134405 - RNA, 20 nt, Artificial Sequence
  mmSKRIPTE0005184_Il34_9
  gRNA
aggacuccaaggcaccucgg

SEQ ID NO: 134406 - RNA, 20 nt, Artificial Sequence
  mmSKRIPTE0005185_Marco_1
  gRNA
guugccaaaucgagugcuag

SEQ ID NO: 134407 - RNA, 20 nt, Artificial Sequence
  mmSKRIPTE0005186_Marco_2
  gRNA
caauggaucacuagcuaucg

SEQ ID NO: 134408 - RNA, 20 nt, Artificial Sequence
  mmSKRIPTE0005187_Marco_3
  gRNA
guucguucuagcugaaaacg

SEQ ID NO: 134409 - RNA, 20 nt, Artificial Sequence
  mmSKRIPTE0005188_Marco_4
  gRNA
gcagggcucccauuuaacug

SEQ ID NO: 134410 - RNA, 20 nt, Artificial Sequence
  mmSKRIPTE0005189_Marco_5
  gRNA
gugacuagaucuuccccggu

SEQ ID NO: 134411 - RNA, 20 nt, Artificial Sequence
  mmSKRIPTE0005190_Marco_6
  gRNA
caccagagucuaaacccugu

SEQ ID NO: 134412 - RNA, 20 nt, Artificial Sequence
  mmSKRIPTE0005191_Marco_7
  gRNA
guuaugagucuugaaaaccc

SEQ ID NO: 134413 - RNA, 20 nt, Artificial Sequence
  mmSKRIPTE0005192_Marco_8
  gRNA
auauugccggagccagugug

SEQ ID NO: 134414 - RNA, 20 nt, Artificial Sequence
  mmSKRIPTE0005193_Marco_9
  gRNA
gugaacgaggcucuccaggu

SEQ ID NO: 134415 - RNA, 20 nt, Artificial Sequence
  mmSKRIPTE0005194_Rab29_1
  gRNA
caagcacuacaaguccaccg

SEQ ID NO: 134416 - RNA, 20 nt, Artificial Sequence
  mmSKRIPTE0005195_Rab29_2
  gRNA
acccuuccuucaccggaggu

SEQ ID NO: 134417 - RNA, 20 nt, Artificial Sequence
  mmSKRIPTE0005196_Rab29_3
  gRNA
aaggaaggugccaaucgcgg

SEQ ID NO: 134418 - RNA, 20 nt, Artificial Sequence
  mmSKRIPTE0005197_Rab29_4
  gRNA
gaggcaaccucgguacccag

SEQ ID NO: 134419 - RNA, 20 nt, Artificial Sequence
  mmSKRIPTE0005198_Rab29_5
  gRNA
cgcucgccagcauugaaccg

SEQ ID NO: 134420 - RNA, 20 nt, Artificial Sequence
  mmSKRIPTE0005199_Rab29_6
  gRNA
aaucagagaagagaauccgu

SEQ ID NO: 134421 - RNA, 20 nt, Artificial Sequence
  mmSKRIPTE0005200_Rab29_7
  gRNA
gagaagcuucaaccaaccga

SEQ ID NO: 134422 - RNA, 20 nt, Artificial Sequence
  mmSKRIPTE0005201_Rab29_8
  gRNA
auguaguucuccgagcagug

SEQ ID NO: 134423 - RNA, 20 nt, Artificial Sequence
  mmSKRIPTE0005202_Rab29_9
  gRNA
cagagacgucuugccaacgg

SEQ ID NO: 134424 - RNA, 20 nt, Artificial Sequence
  mmSKRIPTE0005203_Rnasel_1
  gRNA
cgaagaaucaucuucgacaa

SEQ ID NO: 134425 - RNA, 20 nt, Artificial Sequence
  mmSKRIPTE0005204_Rnasel_2
  gRNA
uuugcgacgacagacaacga

SEQ ID NO: 134426 - RNA, 20 nt, Artificial Sequence
  mmSKRIPTE0005205_Rnasel_3
  gRNA
gaccaguggacaucuaaggu

SEQ ID NO: 134427 - RNA, 20 nt, Artificial Sequence
  mmSKRIPTE0005206_Rnasel_4
  gRNA
uauaggcgaacacaucaaug

SEQ ID NO: 134428 - RNA, 20 nt, Artificial Sequence
  mmSKRIPTE0005207_Rnasel_5
  gRNA
gaucuaugacaaucgagaag

SEQ ID NO: 134429 - RNA, 20 nt, Artificial Sequence
  mmSKRIPTE0005208_Rnasel_6
  gRNA
ggggcugauguuaacgugag

SEQ ID NO: 134430 - RNA, 20 nt, Artificial Sequence
  mmSKRIPTE0005209_Rnasel_7
  gRNA
cgccucacaguucacguugg

SEQ ID NO: 134431 - RNA, 20 nt, Artificial Sequence
  mmSKRIPTE0005210_Rnasel_8
  gRNA
auggugcugacccucaucgg

SEQ ID NO: 134432 - RNA, 20 nt, Artificial Sequence
  mmSKRIPTE0005211_Rnasel_9
  gRNA
guucagcagaguacggauca

SEQ ID NO: 134433 - RNA, 20 nt, Artificial Sequence
  mmSKRIPTE0005212_Fbxo7_1
  gRNA
gcaaagccgcccucgcagag

SEQ ID NO: 134434 - RNA, 20 nt, Artificial Sequence
  mmSKRIPTE0005213_Fbxo7_2
  gRNA
ccccccuuaagcuaccgacg

SEQ ID NO: 134435 - RNA, 20 nt, Artificial Sequence
  mmSKRIPTE0005214_Fbxo7_3
  gRNA
uucuacuccagcagcaacgu

SEQ ID NO: 134436 - RNA, 20 nt, Artificial Sequence
  mmSKRIPTE0005215_Fbxo7_4
  gRNA
ccggaagugacuacucaccg

SEQ ID NO: 134437 - RNA, 20 nt, Artificial Sequence
  mmSKRIPTE0005216_Fbxo7_5
  gRNA
ugagccgcgucgcugucgug

SEQ ID NO: 134438 - RNA, 20 nt, Artificial Sequence
  mmSKRIPTE0005217_Fbxo7_6
  gRNA
gagaugcaccagcacuauca

SEQ ID NO: 134439 - RNA, 20 nt, Artificial Sequence
  mmSKRIPTE0005218_Fbxo7_7
  gRNA
cugaacuaucccaaccgcag

SEQ ID NO: 134440 - RNA, 20 nt, Artificial Sequence
  mmSKRIPTE0005219_Fbxo7_8
  gRNA
uaucaaacagcgcagacaug

SEQ ID NO: 134441 - RNA, 20 nt, Artificial Sequence
  mmSKRIPTE0005220_Fbxo7_9
  gRNA
uacacuaauagugcccagaa

SEQ ID NO: 134442 - RNA, 20 nt, Artificial Sequence
  mmSKRIPTE0005221_Arrb2_1
  gRNA
gacuacuugaaggaccggaa

SEQ ID NO: 134443 - RNA, 20 nt, Artificial Sequence
  mmSKRIPTE0005222_Arrb2_2
  gRNA
cacgggacacuuguacugcg

SEQ ID NO: 134444 - RNA, 20 nt, Artificial Sequence
  mmSKRIPTE0005223_Arrb2_3
  gRNA
caugggaaucucuauccuag

SEQ ID NO: 134445 - RNA, 20 nt, Artificial Sequence
  mmSKRIPTE0005224_Arrb2_4
  gRNA
ugugcggcuuaucaucagaa

SEQ ID NO: 134446 - RNA, 20 nt, Artificial Sequence
  mmSKRIPTE0005225_Arrb2_5
  gRNA
uauguguaccgacccuccgu

SEQ ID NO: 134447 - RNA, 20 nt, Artificial Sequence
  mmSKRIPTE0005226_Arrb2_6
  gRNA
aggcacgucuguuucccggg

SEQ ID NO: 134448 - RNA, 20 nt, Artificial Sequence
  mmSKRIPTE0005227_Arrb2_7
  gRNA
ucuaggcaaacuuacccaca

SEQ ID NO: 134449 - RNA, 20 nt, Artificial Sequence
  mmSKRIPTE0005228_Arrb2_8
  gRNA
agguuucccacacugcgaca

SEQ ID NO: 134450 - RNA, 20 nt, Artificial Sequence
  mmSKRIPTE0005229_Arrb2_9
  gRNA
gguguacaccuugcagaacg

SEQ ID NO: 134451 - RNA, 20 nt, Artificial Sequence
  mmSKRIPTE0005230_Mir21a_1
  gRNA
cgaugucacgaccacgacag

SEQ ID NO: 134452 - RNA, 20 nt, Artificial Sequence
  mmSKRIPTE0005231_Mir21a_2
  gRNA
gucugauaagcuauccgaca

SEQ ID NO: 134453 - RNA, 20 nt, Artificial Sequence
  mmSKRIPTE0005232_Mir21a_3
  gRNA
ucauggcaacagcagucgau

SEQ ID NO: 134454 - RNA, 20 nt, Artificial Sequence
  mmSKRIPTE0005233_Mir21a_4
  gRNA
cacgacagggggcaagcacg

SEQ ID NO: 134455 - RNA, 20 nt, Artificial Sequence
  mmSKRIPTE0005234_Mir21a_5
  gRNA
caaacaucucugguuugcug

SEQ ID NO: 134456 - RNA, 20 nt, Artificial Sequence
  mmSKRIPTE0005235_Hoxb3_1
  gRNA
ccguuagcuuggaggacgug

SEQ ID NO: 134457 - RNA, 20 nt, Artificial Sequence
  mmSKRIPTE0005236_Hoxb3_2
  gRNA
guguccgcuaaugcgacggg

SEQ ID NO: 134458 - RNA, 20 nt, Artificial Sequence
  mmSKRIPTE0005237_Hoxb3_3
  gRNA
uucuacccugaggcggugcg

SEQ ID NO: 134459 - RNA, 20 nt, Artificial Sequence
  mmSKRIPTE0005238_Hoxb3_4
  gRNA
gcagauuggccaucucgacc

SEQ ID NO: 134460 - RNA, 20 nt, Artificial Sequence
  mmSKRIPTE0005239_Hoxb3_5
  gRNA
gcugcagagauacuggcgag

SEQ ID NO: 134461 - RNA, 20 nt, Artificial Sequence
  mmSKRIPTE0005240_Hoxb3_6
  gRNA
uauuccuaagcgguccucga

SEQ ID NO: 134462 - RNA, 20 nt, Artificial Sequence
  mmSKRIPTE0005241_Hoxb3_7
  gRNA
gcagcgcguaggcauucugg

SEQ ID NO: 134463 - RNA, 20 nt, Artificial Sequence
  mmSKRIPTE0005242_Hoxb3_8
  gRNA
ggcgccgcaacccuuaagag

SEQ ID NO: 134464 - RNA, 20 nt, Artificial Sequence
  mmSKRIPTE0005243_Hoxb3_9
  gRNA
ggguuccagcacuaccaagu

SEQ ID NO: 134465 - RNA, 20 nt, Artificial Sequence
  mmSKRIPTE0005244_Mthfd1_1
  gRNA
caaugccuggacucccuacg

SEQ ID NO: 134466 - RNA, 20 nt, Artificial Sequence
  mmSKRIPTE0005245_Mthfd1_2
  gRNA
cucuuccauaggaaugaccu

SEQ ID NO: 134467 - RNA, 20 nt, Artificial Sequence
  mmSKRIPTE0005246_Mthfd1_3
  gRNA
ucgaucccugauuugccuag

SEQ ID NO: 134468 - RNA, 20 nt, Artificial Sequence
  mmSKRIPTE0005247_Mthfd1_4
  gRNA
acacucuacccgucagauag

SEQ ID NO: 134469 - RNA, 20 nt, Artificial Sequence
  mmSKRIPTE0005248_Mthfd1_5
  gRNA
cuucauggcaagcguaagug

SEQ ID NO: 134470 - RNA, 20 nt, Artificial Sequence
  mmSKRIPTE0005249_Mthfd1_6
  gRNA
gcuacggguagccuuacgca

SEQ ID NO: 134471 - RNA, 20 nt, Artificial Sequence
  mmSKRIPTE0005250_Mthfd1_7
  gRNA
cuggauaaguauccugaccc

SEQ ID NO: 134472 - RNA, 20 nt, Artificial Sequence
  mmSKRIPTE0005251_Mthfd1_8
  gRNA
uggacugugcaguuacaaug

SEQ ID NO: 134473 - RNA, 20 nt, Artificial Sequence
  mmSKRIPTE0005252_Mthfd1_9
  gRNA
cacccgagaaggauguggau

SEQ ID NO: 134474 - RNA, 20 nt, Artificial Sequence
  mmSKRIPTE0005253_Ighv5-15_1
  gRNA
cacuuucagugacuacggaa

SEQ ID NO: 134475 - RNA, 20 nt, Artificial Sequence
  mmSKRIPTE0005254_Ighv5-15_2
  gRNA
agugcgggucacugaauggg

SEQ ID NO: 134476 - RNA, 20 nt, Artificial Sequence
  mmSKRIPTE0005255_Ighv5-15_3
  gRNA
agugagugaauguuacugug

SEQ ID NO: 134477 - RNA, 20 nt, Artificial Sequence
  mmSKRIPTE0005256_Ighv5-15_4
  gRNA
ugaguggucuguacugagug

SEQ ID NO: 134478 - RNA, 20 nt, Artificial Sequence
  mmSKRIPTE0005257_Ighv5-15_5
  gRNA
uaagcacauugggccagcag

SEQ ID NO: 134479 - RNA, 20 nt, Artificial Sequence
  mmSKRIPTE0005258_Ighv5-15_6
  gRNA
cugaaggcagugcucauggc

SEQ ID NO: 134480 - RNA, 20 nt, Artificial Sequence
  mmSKRIPTE0005259_Ighv5-15_7
  gRNA
ccaaccuguucaaaaagucc

SEQ ID NO: 134481 - RNA, 20 nt, Artificial Sequence
  mmSKRIPTE0005260_Ighv5-15_8
  gRNA
cuaaugaaugcuacccacuc

SEQ ID NO: 134482 - RNA, 20 nt, Artificial Sequence
  mmSKRIPTE0005261_Ighv5-15_9
  gRNA
gggacugggcuuucucucag

SEQ ID NO: 134483 - RNA, 20 nt, Artificial Sequence
  mmSKRIPTE0005262_Edn1_1
  gRNA
gucguaccguauggacuggg

SEQ ID NO: 134484 - RNA, 20 nt, Artificial Sequence
  mmSKRIPTE0005263_Edn1_2
  gRNA
gcaggccggacaagucaaag

SEQ ID NO: 134485 - RNA, 20 nt, Artificial Sequence
  mmSKRIPTE0005264_Edn1_3
  gRNA
ccacuggggcgaaagcgucg

SEQ ID NO: 134486 - RNA, 20 nt, Artificial Sequence
  mmSKRIPTE0005265_Edn1_4
  gRNA
ucuuagcaagaccaucugug

SEQ ID NO: 134487 - RNA, 20 nt, Artificial Sequence
  mmSKRIPTE0005266_Edn1_5
  gRNA
ugggaacccggauagcggag

SEQ ID NO: 134488 - RNA, 20 nt, Artificial Sequence
  mmSKRIPTE0005267_Edn1_6
  gRNA
cccgccgucugacaauccag

SEQ ID NO: 134489 - RNA, 20 nt, Artificial Sequence
  mmSKRIPTE0005268_Edn1_7
  gRNA
ccauuagcacuggcguccag

SEQ ID NO: 134490 - RNA, 20 nt, Artificial Sequence
  mmSKRIPTE0005269_Edn1_8
  gRNA
acucccgagugagucucuag

SEQ ID NO: 134491 - RNA, 20 nt, Artificial Sequence
  mmSKRIPTE0005270_Edn1_9
  gRNA
ccauuuggggacauacacug

SEQ ID NO: 134492 - RNA, 20 nt, Artificial Sequence
  mmSKRIPTE0005271_Mmp14_1
  gRNA
ccugagaacaagccaucccg

SEQ ID NO: 134493 - RNA, 20 nt, Artificial Sequence
  mmSKRIPTE0005272_Mmp14_2
  gRNA
gcugcaucgaucuuguccgu

SEQ ID NO: 134494 - RNA, 20 nt, Artificial Sequence
  mmSKRIPTE0005273_Mmp14_3
  gRNA
ccguugccuauaaggucaga

SEQ ID NO: 134495 - RNA, 20 nt, Artificial Sequence
  mmSKRIPTE0005274_Mmp14_4
  gRNA
uuauccggaacaccacagcg

SEQ ID NO: 134496 - RNA, 20 nt, Artificial Sequence
  mmSKRIPTE0005275_Mmp14_5
  gRNA
uaguaccggcaggaccacgg

SEQ ID NO: 134497 - RNA, 20 nt, Artificial Sequence
  mmSKRIPTE0005276_Mmp14_6
  gRNA
ugacgggaacuuugacaccg

SEQ ID NO: 134498 - RNA, 20 nt, Artificial Sequence
  mmSKRIPTE0005277_Mmp14_7
  gRNA
ccagggcaacaaccuugucg

SEQ ID NO: 134499 - RNA, 20 nt, Artificial Sequence
  mmSKRIPTE0005278_Mmp14_8
  gRNA
guagggcgggaccgauccag

SEQ ID NO: 134500 - RNA, 20 nt, Artificial Sequence
  mmSKRIPTE0005279_Mmp14_9
  gRNA
uugguauucagcacggucag

SEQ ID NO: 134501 - RNA, 20 nt, Artificial Sequence
  mmSKRIPTE0005280_Klf10_1
  gRNA
acucuggacgagucaaucug

SEQ ID NO: 134502 - RNA, 20 nt, Artificial Sequence
  mmSKRIPTE0005281_Klf10_2
  gRNA
uuaacgucaagcauacacug

SEQ ID NO: 134503 - RNA, 20 nt, Artificial Sequence
  mmSKRIPTE0005282_Klf10_3
  gRNA
cugacuucgaacccucccaa

SEQ ID NO: 134504 - RNA, 20 nt, Artificial Sequence
  mmSKRIPTE0005283_Klf10_4
  gRNA
auaaaccgacggucacacau

SEQ ID NO: 134505 - RNA, 20 nt, Artificial Sequence
  mmSKRIPTE0005284_Klf10_5
  gRNA
augaacuguccagacaccgg

SEQ ID NO: 134506 - RNA, 20 nt, Artificial Sequence
  mmSKRIPTE0005285_Klf10_6
  gRNA
uaucugguuauccaaaccgc

SEQ ID NO: 134507 - RNA, 20 nt, Artificial Sequence
  mmSKRIPTE0005286_Klf10_7
  gRNA
ggaugcuagcugcuuucacg

SEQ ID NO: 134508 - RNA, 20 nt, Artificial Sequence
  mmSKRIPTE0005287_Klf10_8
  gRNA
aaguuguacucacucagacc

SEQ ID NO: 134509 - RNA, 20 nt, Artificial Sequence
  mmSKRIPTE0005288_Klf10_9
  gRNA
gugaucacaccugcaguuug

SEQ ID NO: 134510 - RNA, 20 nt, Artificial Sequence
  mmSKRIPTE0005289_Snx4_1
  gRNA
gaccggaggaugacccgaug

SEQ ID NO: 134511 - RNA, 20 nt, Artificial Sequence
  mmSKRIPTE0005290_Snx4_2
  gRNA
ugucugacucuacuaaggug

SEQ ID NO: 134512 - RNA, 20 nt, Artificial Sequence
  mmSKRIPTE0005291_Snx4_3
  gRNA
uggucccaugaacuuacugg

SEQ ID NO: 134513 - RNA, 20 nt, Artificial Sequence
  mmSKRIPTE0005292_Snx4_4
  gRNA
ggacuaccgagagcgcaggg

SEQ ID NO: 134514 - RNA, 20 nt, Artificial Sequence
  mmSKRIPTE0005293_Snx4_5
  gRNA
gcucaggggucgacacggug

SEQ ID NO: 134515 - RNA, 20 nt, Artificial Sequence
  mmSKRIPTE0005294_Snx4_6
  gRNA
cauuaguggagugcuacgug

SEQ ID NO: 134516 - RNA, 20 nt, Artificial Sequence
  mmSKRIPTE0005295_Snx4_7
  gRNA
gaggaugacccgaugcggag

SEQ ID NO: 134517 - RNA, 20 nt, Artificial Sequence
  mmSKRIPTE0005296_Snx4_8
  gRNA
aaugcugugacgcuuaacaa

SEQ ID NO: 134518 - RNA, 20 nt, Artificial Sequence
  mmSKRIPTE0005297_Snx4_9
  gRNA
gcggucggugaggagaacga

SEQ ID NO: 134519 - RNA, 20 nt, Artificial Sequence
  mmSKRIPTE0005298_Camk1d_1
  gRNA
gcuucacugauaacguacug

SEQ ID NO: 134520 - RNA, 20 nt, Artificial Sequence
  mmSKRIPTE0005299_Camk1d_2
  gRNA
cugguggagaacucuucgau

SEQ ID NO: 134521 - RNA, 20 nt, Artificial Sequence
  mmSKRIPTE0005300_Camk1d_3
  gRNA
guuuccuuucuucuucgucg

SEQ ID NO: 134522 - RNA, 20 nt, Artificial Sequence
  mmSKRIPTE0005301_Camk1d_4
  gRNA
aaaagcccgcugaagaacgg

SEQ ID NO: 134523 - RNA, 20 nt, Artificial Sequence
  mmSKRIPTE0005302_Camk1d_5
  gRNA
ugugcuccaguacaacgaga

SEQ ID NO: 134524 - RNA, 20 nt, Artificial Sequence
  mmSKRIPTE0005303_Camk1d_6
  gRNA
cggcagucgugagacauaug

SEQ ID NO: 134525 - RNA, 20 nt, Artificial Sequence
  mmSKRIPTE0005304_Camk1d_7
  gRNA
gauauaggcgaucaccccga

SEQ ID NO: 134526 - RNA, 20 nt, Artificial Sequence
  mmSKRIPTE0005305_Camk1d_8
  gRNA
uggaccccagaaccucacga

SEQ ID NO: 134527 - RNA, 20 nt, Artificial Sequence
  mmSKRIPTE0005306_Camk1d_9
  gRNA
cuuauacuacagucaagacg

SEQ ID NO: 134528 - RNA, 20 nt, Artificial Sequence
  mmSKRIPTE0005307_Abi1_1
  gRNA
uaaugcgagaggaagcgaug

SEQ ID NO: 134529 - RNA, 20 nt, Artificial Sequence
  mmSKRIPTE0005308_Abi1_2
  gRNA
uccagaacuguauagucgau

SEQ ID NO: 134530 - RNA, 20 nt, Artificial Sequence
  mmSKRIPTE0005309_Abi1_3
  gRNA
acuacaugacuaguccugcg

SEQ ID NO: 134531 - RNA, 20 nt, Artificial Sequence
  mmSKRIPTE0005310_Abi1_4
  gRNA
agaggaagcugaguccgccg

SEQ ID NO: 134532 - RNA, 20 nt, Artificial Sequence
  mmSKRIPTE0005311_Abi1_5
  gRNA
uaaaauccaaaggaccggug

SEQ ID NO: 134533 - RNA, 20 nt, Artificial Sequence
  mmSKRIPTE0005312_Abi1_6
  gRNA
aaagucccucggcccgacac

SEQ ID NO: 134534 - RNA, 20 nt, Artificial Sequence
  mmSKRIPTE0005313_Abi1_7
  gRNA
aucagagaccaaggacgcau

SEQ ID NO: 134535 - RNA, 20 nt, Artificial Sequence
  mmSKRIPTE0005314_Abi1_8
  gRNA
uauaugcugucccuaugcau

SEQ ID NO: 134536 - RNA, 20 nt, Artificial Sequence
  mmSKRIPTE0005315_Abi1_9
  gRNA
uuaccagaaccugacccggg

SEQ ID NO: 134537 - RNA, 20 nt, Artificial Sequence
  mmSKRIPTE0005316_Padi4_1
  gRNA
uacaacggggagguucacug

SEQ ID NO: 134538 - RNA, 20 nt, Artificial Sequence
  mmSKRIPTE0005317_Padi4_2
  gRNA
ucacccgcggacauccagcg

SEQ ID NO: 134539 - RNA, 20 nt, Artificial Sequence
  mmSKRIPTE0005318_Padi4_3
  gRNA
gagauggaacucucgccuug

SEQ ID NO: 134540 - RNA, 20 nt, Artificial Sequence
  mmSKRIPTE0005319_Padi4_4
  gRNA
aggaaccuuacgacucugca

SEQ ID NO: 134541 - RNA, 20 nt, Artificial Sequence
  mmSKRIPTE0005320_Padi4_5
  gRNA
gggcuacgacaagaccacau

SEQ ID NO: 134542 - RNA, 20 nt, Artificial Sequence
  mmSKRIPTE0005321_Padi4_6
  gRNA
augaggcucccaugccugcg

SEQ ID NO: 134543 - RNA, 20 nt, Artificial Sequence
  mmSKRIPTE0005322_Padi4_7
  gRNA
guucacgugagacccuggug

SEQ ID NO: 134544 - RNA, 20 nt, Artificial Sequence
  mmSKRIPTE0005323_Padi4_8
  gRNA
aaacuuguuccaucuaugag

SEQ ID NO: 134545 - RNA, 20 nt, Artificial Sequence
  mmSKRIPTE0005324_Padi4_9
  gRNA
agcccugaucuacaucacug

SEQ ID NO: 134546 - RNA, 20 nt, Artificial Sequence
  mmSKRIPTE0005325_Rbpj_1
  gRNA
auugcaguugaauggcggcg

SEQ ID NO: 134547 - RNA, 20 nt, Artificial Sequence
  mmSKRIPTE0005326_Rbpj_2
  gRNA
ggggauccuauuuagaugcg

SEQ ID NO: 134548 - RNA, 20 nt, Artificial Sequence
  mmSKRIPTE0005327_Rbpj_3
  gRNA
uggcugucggugguacacaa

SEQ ID NO: 134549 - RNA, 20 nt, Artificial Sequence
  mmSKRIPTE0005328_Rbpj_4
  gRNA
guccaauaaaauacuaacgu

SEQ ID NO: 134550 - RNA, 20 nt, Artificial Sequence
  mmSKRIPTE0005329_Rbpj_5
  gRNA
aaaucaggcagugacgcgag

SEQ ID NO: 134551 - RNA, 20 nt, Artificial Sequence
  mmSKRIPTE0005330_Rbpj_6
  gRNA
agcccuccgaguaguccaug

SEQ ID NO: 134552 - RNA, 20 nt, Artificial Sequence
  mmSKRIPTE0005331_Rbpj_7
  gRNA
aaacaucucugaucgaaacc

SEQ ID NO: 134553 - RNA, 20 nt, Artificial Sequence
  mmSKRIPTE0005332_Rbpj_8
  gRNA
ucuucuagucaauugacacu

SEQ ID NO: 134554 - RNA, 20 nt, Artificial Sequence
  mmSKRIPTE0005333_Rbpj_9
  gRNA
gagaaugagacacuacauag

SEQ ID NO: 134555 - RNA, 20 nt, Artificial Sequence
  mmSKRIPTE0005334_Ube2k_1
  gRNA
gucuugugggaaacgugcug

SEQ ID NO: 134556 - RNA, 20 nt, Artificial Sequence
  mmSKRIPTE0005335_Ube2k_2
  gRNA
gcucgggucugaaucgcuga

SEQ ID NO: 134557 - RNA, 20 nt, Artificial Sequence
  mmSKRIPTE0005336_Ube2k_3
  gRNA
gcggaggugauucuacagug

SEQ ID NO: 134558 - RNA, 20 nt, Artificial Sequence
  mmSKRIPTE0005337_Ube2k_4
  gRNA
auauccauuuaaccccccua

SEQ ID NO: 134559 - RNA, 20 nt, Artificial Sequence
  mmSKRIPTE0005338_Ube2k_5
  gRNA
ugcauaccuucacaacagag

SEQ ID NO: 134560 - RNA, 20 nt, Artificial Sequence
  mmSKRIPTE0005339_Ube2k_6
  gRNA
gagguguguuugagacucga

SEQ ID NO: 134561 - RNA, 20 nt, Artificial Sequence
  mmSKRIPTE0005340_Ube2k_7
  gRNA
aggcggguacgaaucagcug

SEQ ID NO: 134562 - RNA, 20 nt, Artificial Sequence
  mmSKRIPTE0005341_Ube2k_8
  gRNA
acacgugggguaaccuacac

SEQ ID NO: 134563 - RNA, 20 nt, Artificial Sequence
  mmSKRIPTE0005342_Ube2k_9
  gRNA
aucccuaccaagcuagaaca

SEQ ID NO: 134564 - RNA, 20 nt, Artificial Sequence
  mmSKRIPTE0005343_Zp3_1
  gRNA
cauccucaggacuaaccgug

SEQ ID NO: 134565 - RNA, 20 nt, Artificial Sequence
  mmSKRIPTE0005344_Zp3_2
  gRNA
ucgguauccacggacacccg

SEQ ID NO: 134566 - RNA, 20 nt, Artificial Sequence
  mmSKRIPTE0005345_Zp3_3
  gRNA
auaacccagauucugaucgu

SEQ ID NO: 134567 - RNA, 20 nt, Artificial Sequence
  mmSKRIPTE0005346_Zp3_4
  gRNA
cauuccccuaagcaacccga

SEQ ID NO: 134568 - RNA, 20 nt, Artificial Sequence
  mmSKRIPTE0005347_Zp3_5
  gRNA
uuccauauaaacccaucccg

SEQ ID NO: 134569 - RNA, 20 nt, Artificial Sequence
  mmSKRIPTE0005348_Zp3_6
  gRNA
gugaaggcguggccacgcag

SEQ ID NO: 134570 - RNA, 20 nt, Artificial Sequence
  mmSKRIPTE0005349_Zp3_7
  gRNA
gucuuccugcugucaagugu

SEQ ID NO: 134571 - RNA, 20 nt, Artificial Sequence
  mmSKRIPTE0005350_Zp3_8
  gRNA
acucaauggguaccuccaca

SEQ ID NO: 134572 - RNA, 20 nt, Artificial Sequence
  mmSKRIPTE0005351_Zp3_9
  gRNA
cguucaacaagacuucccag

SEQ ID NO: 134573 - RNA, 20 nt, Artificial Sequence
  mmSKRIPTE0005352_Il23r_1
  gRNA
aaggucucaauuucgcccug

SEQ ID NO: 134574 - RNA, 20 nt, Artificial Sequence
  mmSKRIPTE0005353_Il23r_2
  gRNA
guacacauguauauucgcug

SEQ ID NO: 134575 - RNA, 20 nt, Artificial Sequence
  mmSKRIPTE0005354_Il23r_3
  gRNA
agggugugcauggaaaucac

SEQ ID NO: 134576 - RNA, 20 nt, Artificial Sequence
  mmSKRIPTE0005355_Il23r_4
  gRNA
acauauauauggccuaaacc

SEQ ID NO: 134577 - RNA, 20 nt, Artificial Sequence
  mmSKRIPTE0005356_Il23r_5
  gRNA
ucuauaguacuuacguccag

SEQ ID NO: 134578 - RNA, 20 nt, Artificial Sequence
  mmSKRIPTE0005357_Il23r_6
  gRNA
cucagugcuacaaucuucag

SEQ ID NO: 134579 - RNA, 20 nt, Artificial Sequence
  mmSKRIPTE0005358_Il23r_7
  gRNA
cuauaggaaaauauacugag

SEQ ID NO: 134580 - RNA, 20 nt, Artificial Sequence
  mmSKRIPTE0005359_Il23r_8
  gRNA
cucuucagauggugucacgg

SEQ ID NO: 134581 - RNA, 20 nt, Artificial Sequence
  mmSKRIPTE0005360_Il23r_9
  gRNA
cugguagacaacauuccuag

SEQ ID NO: 134582 - RNA, 20 nt, Artificial Sequence
  mmSKRIPTE0005361_Dock1_1
  gRNA
uuaagggucucaaaccagcg

SEQ ID NO: 134583 - RNA, 20 nt, Artificial Sequence
  mmSKRIPTE0005362_Dock1_2
  gRNA
ggcguuaguccacaggacga

SEQ ID NO: 134584 - RNA, 20 nt, Artificial Sequence
  mmSKRIPTE0005363_Dock1_3
  gRNA
uuauuggacuaaucgcggau

SEQ ID NO: 134585 - RNA, 20 nt, Artificial Sequence
  mmSKRIPTE0005364_Dock1_4
  gRNA
acuacgacagagcgaaugcg

SEQ ID NO: 134586 - RNA, 20 nt, Artificial Sequence
  mmSKRIPTE0005365_Dock1_5
  gRNA
cuaggguugugcuauuacug

SEQ ID NO: 134587 - RNA, 20 nt, Artificial Sequence
  mmSKRIPTE0005366_Dock1_6
  gRNA
uugauaaaauacccgcaaug

SEQ ID NO: 134588 - RNA, 20 nt, Artificial Sequence
  mmSKRIPTE0005367_Dock1_7
  gRNA
ucuauggagguccuuaucaa

SEQ ID NO: 134589 - RNA, 20 nt, Artificial Sequence
  mmSKRIPTE0005368_Dock1_8
  gRNA
auaccacaauuccuugacug

SEQ ID NO: 134590 - RNA, 20 nt, Artificial Sequence
  mmSKRIPTE0005369_Dock1_9
  gRNA
uauuuaccagccacgccgaa

SEQ ID NO: 134591 - RNA, 20 nt, Artificial Sequence
  mmSKRIPTE0005370_Fadd_1
  gRNA
gcccaggcuuccuagcgcau

SEQ ID NO: 134592 - RNA, 20 nt, Artificial Sequence
  mmSKRIPTE0005371_Fadd_2
  gRNA
uugccuuacaguuggccaag

SEQ ID NO: 134593 - RNA, 20 nt, Artificial Sequence
  mmSKRIPTE0005372_Fadd_3
  gRNA
cagugguggagaacacgacg

SEQ ID NO: 134594 - RNA, 20 nt, Artificial Sequence
  mmSKRIPTE0005373_Fadd_4
  gRNA
agcccggcguaccacugcca

SEQ ID NO: 134595 - RNA, 20 nt, Artificial Sequence
  mmSKRIPTE0005374_Fadd_5
  gRNA
ccggacugguuaaggcgcug

SEQ ID NO: 134596 - RNA, 20 nt, Artificial Sequence
  mmSKRIPTE0005375_Fadd_6
  gRNA
acaucccgcgagacgcuggg

SEQ ID NO: 134597 - RNA, 20 nt, Artificial Sequence
  mmSKRIPTE0005376_Fadd_7
  gRNA
gcgccuggacgacuucgagg

SEQ ID NO: 134598 - RNA, 20 nt, Artificial Sequence
  mmSKRIPTE0005377_Fadd_8
  gRNA
ccacguuggggauuaaaacg

SEQ ID NO: 134599 - RNA, 20 nt, Artificial Sequence
  mmSKRIPTE0005378_Fadd_9
  gRNA
uuuccuaugugggaucgcug

SEQ ID NO: 134600 - RNA, 20 nt, Artificial Sequence
  mmSKRIPTE0005379_Cd209a_1
  gRNA
agccucacgucccuaaccug

SEQ ID NO: 134601 - RNA, 20 nt, Artificial Sequence
  mmSKRIPTE0005380_Cd209a_2
  gRNA
acgcucuauucacuuagaug

SEQ ID NO: 134602 - RNA, 20 nt, Artificial Sequence
  mmSKRIPTE0005381_Cd209a_3
  gRNA
cuguggaccaggcacccugu

SEQ ID NO: 134603 - RNA, 20 nt, Artificial Sequence
  mmSKRIPTE0005382_Cd209a_4
  gRNA
acauaaacuuaguuucugug

SEQ ID NO: 134604 - RNA, 20 nt, Artificial Sequence
  mmSKRIPTE0005383_Cd209a_5
  gRNA
caaguugagcccccacauug

SEQ ID NO: 134605 - RNA, 20 nt, Artificial Sequence
  mmSKRIPTE0005384_Cd209a_6
  gRNA
gagacuaucuaagagagacg

SEQ ID NO: 134606 - RNA, 20 nt, Artificial Sequence
  mmSKRIPTE0005385_Cd209a_7
  gRNA
aagucuggcucuucaaacga

SEQ ID NO: 134607 - RNA, 20 nt, Artificial Sequence
  mmSKRIPTE0005386_Cd209a_8
  gRNA
gagcaucugacacaccaggc

SEQ ID NO: 134608 - RNA, 20 nt, Artificial Sequence
  mmSKRIPTE0005387_Cd209a_9
  gRNA
ggggcucauugacaugagca

SEQ ID NO: 134609 - RNA, 20 nt, Artificial Sequence
  mmSKRIPTE0005388_Jak3_1
  gRNA
aauuugaucguggugcgaag

SEQ ID NO: 134610 - RNA, 20 nt, Artificial Sequence
  mmSKRIPTE0005389_Jak3_2
  gRNA
guagugcaaucagucccgcc

SEQ ID NO: 134611 - RNA, 20 nt, Artificial Sequence
  mmSKRIPTE0005390_Jak3_3
  gRNA
ccaccgcacagcucaucucg

SEQ ID NO: 134612 - RNA, 20 nt, Artificial Sequence
  mmSKRIPTE0005391_Jak3_4
  gRNA
agagagccaugauagcacgu

SEQ ID NO: 134613 - RNA, 20 nt, Artificial Sequence
  mmSKRIPTE0005392_Jak3_5
  gRNA
aagacccggauagcagccag

SEQ ID NO: 134614 - RNA, 20 nt, Artificial Sequence
  mmSKRIPTE0005393_Jak3_6
  gRNA
ucuagggcggggaucacgug

SEQ ID NO: 134615 - RNA, 20 nt, Artificial Sequence
  mmSKRIPTE0005394_Jak3_7
  gRNA
cgugcugagacguugccgug

SEQ ID NO: 134616 - RNA, 20 nt, Artificial Sequence
  mmSKRIPTE0005395_Jak3_8
  gRNA
auggggcaggcgacgcacag

SEQ ID NO: 134617 - RNA, 20 nt, Artificial Sequence
  mmSKRIPTE0005396_Jak3_9
  gRNA
uagggggccauuaaacugag

SEQ ID NO: 134618 - RNA, 20 nt, Artificial Sequence
  mmSKRIPTE0005397_Inpp4b_1
  gRNA
uuacaauaguggauguccca

SEQ ID NO: 134619 - RNA, 20 nt, Artificial Sequence
  mmSKRIPTE0005398_Inpp4b_2
  gRNA
ggcuugauaguacaauacga

SEQ ID NO: 134620 - RNA, 20 nt, Artificial Sequence
  mmSKRIPTE0005399_Inpp4b_3
  gRNA
aaaaugaguucuuaccacgu

SEQ ID NO: 134621 - RNA, 20 nt, Artificial Sequence
  mmSKRIPTE0005400_Inpp4b_4
  gRNA
uguauugccaacacccugug

SEQ ID NO: 134622 - RNA, 20 nt, Artificial Sequence
  mmSKRIPTE0005401_Inpp4b_5
  gRNA
guucuggcacagacgaugga

SEQ ID NO: 134623 - RNA, 20 nt, Artificial Sequence
  mmSKRIPTE0005402_Inpp4b_6
  gRNA
uauaauacugagcguauaca

SEQ ID NO: 134624 - RNA, 20 nt, Artificial Sequence
  mmSKRIPTE0005403_Inpp4b_7
  gRNA
acuuaaucauaucuuuccga

SEQ ID NO: 134625 - RNA, 20 nt, Artificial Sequence
  mmSKRIPTE0005404_Inpp4b_8
  gRNA
aaugagcuccgguuuaacgu

SEQ ID NO: 134626 - RNA, 20 nt, Artificial Sequence
  mmSKRIPTE0005405_Inpp4b_9
  gRNA
gacucucgagggagguacgg

SEQ ID NO: 134627 - RNA, 20 nt, Artificial Sequence
  mmSKRIPTE0005406_Nod2_1
  gRNA
gucaauuccagacggcaaug

SEQ ID NO: 134628 - RNA, 20 nt, Artificial Sequence
  mmSKRIPTE0005407_Nod2_2
  gRNA
uaagagacucaugagccgag

SEQ ID NO: 134629 - RNA, 20 nt, Artificial Sequence
  mmSKRIPTE0005408_Nod2_3
  gRNA
ccgacccaucguaaguacug

SEQ ID NO: 134630 - RNA, 20 nt, Artificial Sequence
  mmSKRIPTE0005409_Nod2_4
  gRNA
gcgcugacacagcauccgga

SEQ ID NO: 134631 - RNA, 20 nt, Artificial Sequence
  mmSKRIPTE0005410_Nod2_5
  gRNA
aguccaggucccagaccgag

SEQ ID NO: 134632 - RNA, 20 nt, Artificial Sequence
  mmSKRIPTE0005411_Nod2_6
  gRNA
cugcagaaacuagcgugagu

SEQ ID NO: 134633 - RNA, 20 nt, Artificial Sequence
  mmSKRIPTE0005412_Nod2_7
  gRNA
ggcauuauuguaccaucaca

SEQ ID NO: 134634 - RNA, 20 nt, Artificial Sequence
  mmSKRIPTE0005413_Nod2_8
  gRNA
gcagagucuggacugacgug

SEQ ID NO: 134635 - RNA, 20 nt, Artificial Sequence
  mmSKRIPTE0005414_Nod2_9
  gRNA
gagcacacucaaccagcgug

SEQ ID NO: 134636 - RNA, 20 nt, Artificial Sequence
  mmSKRIPTE0005415_Pum2_1
  gRNA
aggugccuuagaaaggaacg

SEQ ID NO: 134637 - RNA, 20 nt, Artificial Sequence
  mmSKRIPTE0005416_Pum2_2
  gRNA
ggaugcuguaaggacaaacg

SEQ ID NO: 134638 - RNA, 20 nt, Artificial Sequence
  mmSKRIPTE0005417_Pum2_3
  gRNA
caugccuauuggacuuggag

SEQ ID NO: 134639 - RNA, 20 nt, Artificial Sequence
  mmSKRIPTE0005418_Pum2_4
  gRNA
ugaauccagagaaacgugcg

SEQ ID NO: 134640 - RNA, 20 nt, Artificial Sequence
  mmSKRIPTE0005419_Pum2_5
  gRNA
acgcaucagcugccaaacgu

SEQ ID NO: 134641 - RNA, 20 nt, Artificial Sequence
  mmSKRIPTE0005420_Pum2_6
  gRNA
cuaagguccaggccaaccca

SEQ ID NO: 134642 - RNA, 20 nt, Artificial Sequence
  mmSKRIPTE0005421_Pum2_7
  gRNA
cugccguuaauacgauggag

SEQ ID NO: 134643 - RNA, 20 nt, Artificial Sequence
  mmSKRIPTE0005422_Pum2_8
  gRNA
ugaugucagaucuauuauag

SEQ ID NO: 134644 - RNA, 20 nt, Artificial Sequence
  mmSKRIPTE0005423_Pum2_9
  gRNA
gcucuugcauuagaaucucg

SEQ ID NO: 134645 - RNA, 20 nt, Artificial Sequence
  mmSKRIPTE0005424_Pms2_1
  gRNA
gacuacagguuuggacggug

SEQ ID NO: 134646 - RNA, 20 nt, Artificial Sequence
  mmSKRIPTE0005425_Pms2_2
  gRNA
uugauccacgauaacagacc

SEQ ID NO: 134647 - RNA, 20 nt, Artificial Sequence
  mmSKRIPTE0005426_Pms2_3
  gRNA
guaaccuugagggaucacac

SEQ ID NO: 134648 - RNA, 20 nt, Artificial Sequence
  mmSKRIPTE0005427_Pms2_4
  gRNA
gugauaucuaucacaguacg

SEQ ID NO: 134649 - RNA, 20 nt, Artificial Sequence
  mmSKRIPTE0005428_Pms2_5
  gRNA
uucacacacagcgucacuag

SEQ ID NO: 134650 - RNA, 20 nt, Artificial Sequence
  mmSKRIPTE0005429_Pms2_6
  gRNA
gcuacuugggagaucccggu

SEQ ID NO: 134651 - RNA, 20 nt, Artificial Sequence
  mmSKRIPTE0005430_Pms2_7
  gRNA
uggagcaaaccgaaggcgug

SEQ ID NO: 134652 - RNA, 20 nt, Artificial Sequence
  mmSKRIPTE0005431_Pms2_8
  gRNA
gagugcugugauaaccagcg

SEQ ID NO: 134653 - RNA, 20 nt, Artificial Sequence
  mmSKRIPTE0005432_Pms2_9
  gRNA
uaugauccgccccuuccggg

SEQ ID NO: 134654 - RNA, 20 nt, Artificial Sequence
  mmSKRIPTE0005433_Myb_1
  gRNA
gucguccuacgaaaaaggcg

SEQ ID NO: 134655 - RNA, 20 nt, Artificial Sequence
  mmSKRIPTE0005434_Myb_2
  gRNA
ugugugaccaugacuacgau

SEQ ID NO: 134656 - RNA, 20 nt, Artificial Sequence
  mmSKRIPTE0005435_Myb_3
  gRNA
aggugcaugaucguccacca

SEQ ID NO: 134657 - RNA, 20 nt, Artificial Sequence
  mmSKRIPTE0005436_Myb_4
  gRNA
agguuaacgauaagucacgu

SEQ ID NO: 134658 - RNA, 20 nt, Artificial Sequence
  mmSKRIPTE0005437_Myb_5
  gRNA
uaccccagugagauugaacg

SEQ ID NO: 134659 - RNA, 20 nt, Artificial Sequence
  mmSKRIPTE0005438_Myb_6
  gRNA
acagagccggaacugccucg

SEQ ID NO: 134660 - RNA, 20 nt, Artificial Sequence
  mmSKRIPTE0005439_Myb_7
  gRNA
cccguaugacgccgucagcg

SEQ ID NO: 134661 - RNA, 20 nt, Artificial Sequence
  mmSKRIPTE0005440_Myb_8
  gRNA
gggauauucgcuguugacgg

SEQ ID NO: 134662 - RNA, 20 nt, Artificial Sequence
  mmSKRIPTE0005441_Myb_9
  gRNA
agaccccgacacagguaaug

SEQ ID NO: 134663 - RNA, 20 nt, Artificial Sequence
  mmSKRIPTE0005442_Cartpt_1
  gRNA
gaacccggagccuuaccaug

SEQ ID NO: 134664 - RNA, 20 nt, Artificial Sequence
  mmSKRIPTE0005443_Cartpt_2
  gRNA
guuccccucagagagcggau

SEQ ID NO: 134665 - RNA, 20 nt, Artificial Sequence
  mmSKRIPTE0005444_Cartpt_3
  gRNA
ccugagcugaugguaccaug

SEQ ID NO: 134666 - RNA, 20 nt, Artificial Sequence
  mmSKRIPTE0005445_Cartpt_4
  gRNA
gagcccgggacacacaaccg

SEQ ID NO: 134667 - RNA, 20 nt, Artificial Sequence
  mmSKRIPTE0005446_Cartpt_5
  gRNA
gaauugcaggaaguuccucg

SEQ ID NO: 134668 - RNA, 20 nt, Artificial Sequence
  mmSKRIPTE0005447_Cartpt_6
  gRNA
ccccaaaggcagaagaacgu

SEQ ID NO: 134669 - RNA, 20 nt, Artificial Sequence
  mmSKRIPTE0005448_Cartpt_7
  gRNA
cuggagagcagugcgcagug

SEQ ID NO: 134670 - RNA, 20 nt, Artificial Sequence
  mmSKRIPTE0005449_Cartpt_8
  gRNA
auugccuagaaucuuacaca

SEQ ID NO: 134671 - RNA, 20 nt, Artificial Sequence
  mmSKRIPTE0005450_Cartpt_9
  gRNA
acccugugguaguccagugg

SEQ ID NO: 134672 - RNA, 20 nt, Artificial Sequence
  mmSKRIPTE0005451_Trib1_1
  gRNA
ugggguaccucuaauauccg

SEQ ID NO: 134673 - RNA, 20 nt, Artificial Sequence
  mmSKRIPTE0005452_Trib1_2
  gRNA
guuaggugaacaaacgugcg

SEQ ID NO: 134674 - RNA, 20 nt, Artificial Sequence
  mmSKRIPTE0005453_Trib1_3
  gRNA
ggagcgcgcaggauuccgag

SEQ ID NO: 134675 - RNA, 20 nt, Artificial Sequence
  mmSKRIPTE0005454_Trib1_4
  gRNA
cauaggguuugguaacccga

SEQ ID NO: 134676 - RNA, 20 nt, Artificial Sequence
  mmSKRIPTE0005455_Trib1_5
  gRNA
aacaguagacccggaccgcg

SEQ ID NO: 134677 - RNA, 20 nt, Artificial Sequence
  mmSKRIPTE0005456_Trib1_6
  gRNA
uucccggguguugagccucg

SEQ ID NO: 134678 - RNA, 20 nt, Artificial Sequence
  mmSKRIPTE0005457_Trib1_7
  gRNA
ggaagccggguugugcaaug

SEQ ID NO: 134679 - RNA, 20 nt, Artificial Sequence
  mmSKRIPTE0005458_Trib1_8
  gRNA
gagacaugcacuccuaugug

SEQ ID NO: 134680 - RNA, 20 nt, Artificial Sequence
  mmSKRIPTE0005459_Trib1_9
  gRNA
aaucaggggcagacacccga

SEQ ID NO: 134681 - RNA, 20 nt, Artificial Sequence
  mmSKRIPTE0005460_Tnf_1
  gRNA
uuacagucacggcucccgug

SEQ ID NO: 134682 - RNA, 20 nt, Artificial Sequence
  mmSKRIPTE0005461_Tnf_2
  gRNA
gagaaaaccaugaucucaug

SEQ ID NO: 134683 - RNA, 20 nt, Artificial Sequence
  mmSKRIPTE0005462_Tnf_3
  gRNA
cuucugccaguuccacgucg

SEQ ID NO: 134684 - RNA, 20 nt, Artificial Sequence
  mmSKRIPTE0005463_Tnf_4
  gRNA
gauguggagugugaacuaag

SEQ ID NO: 134685 - RNA, 20 nt, Artificial Sequence
  mmSKRIPTE0005464_Tnf_5
  gRNA
aagcggggcaaucagccggg

SEQ ID NO: 134686 - RNA, 20 nt, Artificial Sequence
  mmSKRIPTE0005465_Tnf_6
  gRNA
ucggggugaucgguccccaa

SEQ ID NO: 134687 - RNA, 20 nt, Artificial Sequence
  mmSKRIPTE0005466_Tnf_7
  gRNA
aagccuguagcccacgucgu

SEQ ID NO: 134688 - RNA, 20 nt, Artificial Sequence
  mmSKRIPTE0005467_Tnf_8
  gRNA
gggugaggagcacguagucg

SEQ ID NO: 134689 - RNA, 20 nt, Artificial Sequence
  mmSKRIPTE0005468_Tnf_9
  gRNA
guagacaagguacaacccau

SEQ ID NO: 134690 - RNA, 20 nt, Artificial Sequence
  mmSKRIPTE0005469_Traf6_1
  gRNA
auugagaaaacuucuuugcg

SEQ ID NO: 134691 - RNA, 20 nt, Artificial Sequence
  mmSKRIPTE0005470_Traf6_2
  gRNA
ugccguguauguaggcgacg

SEQ ID NO: 134692 - RNA, 20 nt, Artificial Sequence
  mmSKRIPTE0005471_Traf6_3
  gRNA
ucugugacccuaauguggag

SEQ ID NO: 134693 - RNA, 20 nt, Artificial Sequence
  mmSKRIPTE0005472_Traf6_4
  gRNA
augugauuggcacuacacga

SEQ ID NO: 134694 - RNA, 20 nt, Artificial Sequence
  mmSKRIPTE0005473_Traf6_5
  gRNA
ggcgggguaaggcuucagcg

SEQ ID NO: 134695 - RNA, 20 nt, Artificial Sequence
  mmSKRIPTE0005474_Traf6_6
  gRNA
ugcagcaaugcucgaagcag

SEQ ID NO: 134696 - RNA, 20 nt, Artificial Sequence
  mmSKRIPTE0005475_Traf6_7
  gRNA
acaaucccacggaaccccaa

SEQ ID NO: 134697 - RNA, 20 nt, Artificial Sequence
  mmSKRIPTE0005476_Traf6_8
  gRNA
aaaggcucuaacuagucgua

SEQ ID NO: 134698 - RNA, 20 nt, Artificial Sequence
  mmSKRIPTE0005477_Traf6_9
  gRNA
cuaccugagguguauucuag

SEQ ID NO: 134699 - RNA, 20 nt, Artificial Sequence
  mmSKRIPTE0005478_Arhgef2_1
  gRNA
gaaucguguuggcaagacgg

SEQ ID NO: 134700 - RNA, 20 nt, Artificial Sequence
  mmSKRIPTE0005479_Arhgef2_2
  gRNA
augcagcgucccgagacgac

SEQ ID NO: 134701 - RNA, 20 nt, Artificial Sequence
  mmSKRIPTE0005480_Arhgef2_3
  gRNA
gucuuccccgauaccuacga

SEQ ID NO: 134702 - RNA, 20 nt, Artificial Sequence
  mmSKRIPTE0005481_Arhgef2_4
  gRNA
gaacucacucuuacuucgaa

SEQ ID NO: 134703 - RNA, 20 nt, Artificial Sequence
  mmSKRIPTE0005482_Arhgef2_5
  gRNA
acgggagaacuagaggucga

SEQ ID NO: 134704 - RNA, 20 nt, Artificial Sequence
  mmSKRIPTE0005483_Arhgef2_6
  gRNA
gcagcuuuccauucgcagag

SEQ ID NO: 134705 - RNA, 20 nt, Artificial Sequence
  mmSKRIPTE0005484_Arhgef2_7
  gRNA
agcucccauacgcuacccug

SEQ ID NO: 134706 - RNA, 20 nt, Artificial Sequence
  mmSKRIPTE0005485_Arhgef2_8
  gRNA
ugggagacgagauuagucag

SEQ ID NO: 134707 - RNA, 20 nt, Artificial Sequence
  mmSKRIPTE0005486_Arhgef2_9
  gRNA
ucccaggaaauaugccgacu

SEQ ID NO: 134708 - RNA, 20 nt, Artificial Sequence
  mmSKRIPTE0005487_Nfkb1_1
  gRNA
ccacccauaauucaucguag

SEQ ID NO: 134709 - RNA, 20 nt, Artificial Sequence
  mmSKRIPTE0005488_Nfkb1_2
  gRNA
caaaacagguaagcguaaag

SEQ ID NO: 134710 - RNA, 20 nt, Artificial Sequence
  mmSKRIPTE0005489_Nfkb1_3
  gRNA
ugauauacuaccacaaggug

SEQ ID NO: 134711 - RNA, 20 nt, Artificial Sequence
  mmSKRIPTE0005490_Nfkb1_4
  gRNA
auguaaacacucccgcugag

SEQ ID NO: 134712 - RNA, 20 nt, Artificial Sequence
  mmSKRIPTE0005491_Nfkb1_5
  gRNA
cugggcgcccuguaaccgag

SEQ ID NO: 134713 - RNA, 20 nt, Artificial Sequence
  mmSKRIPTE0005492_Nfkb1_6
  gRNA
guccuuguacgaaaccccug

SEQ ID NO: 134714 - RNA, 20 nt, Artificial Sequence
  mmSKRIPTE0005493_Nfkb1_7
  gRNA
ugagcaucaagguaaacccg

SEQ ID NO: 134715 - RNA, 20 nt, Artificial Sequence
  mmSKRIPTE0005494_Nfkb1_8
  gRNA
ccuuaucucuuagcaagcgu

SEQ ID NO: 134716 - RNA, 20 nt, Artificial Sequence
  mmSKRIPTE0005495_Nfkb1_9
  gRNA
augacagaggcguguauuag

SEQ ID NO: 134717 - RNA, 20 nt, Artificial Sequence
  mmSKRIPTE0005496_Lyn_1
  gRNA
gauagggaacuucgcaccug

SEQ ID NO: 134718 - RNA, 20 nt, Artificial Sequence
  mmSKRIPTE0005497_Lyn_2
  gRNA
cugacagaagucgagcuacg

SEQ ID NO: 134719 - RNA, 20 nt, Artificial Sequence
  mmSKRIPTE0005498_Lyn_3
  gRNA
uggaaauacacauggccggg

SEQ ID NO: 134720 - RNA, 20 nt, Artificial Sequence
  mmSKRIPTE0005499_Lyn_4
  gRNA
agaccuaacguggaagacga

SEQ ID NO: 134721 - RNA, 20 nt, Artificial Sequence
  mmSKRIPTE0005500_Lyn_5
  gRNA
uaugcacacuggcucuacag

SEQ ID NO: 134722 - RNA, 20 nt, Artificial Sequence
  mmSKRIPTE0005501_Lyn_6
  gRNA
cacgcgacgggauagcccug

SEQ ID NO: 134723 - RNA, 20 nt, Artificial Sequence
  mmSKRIPTE0005502_Lyn_7
  gRNA
aguaucagcagcaaccguag

SEQ ID NO: 134724 - RNA, 20 nt, Artificial Sequence
  mmSKRIPTE0005503_Lyn_8
  gRNA
accacgagcgaguaaguccg

SEQ ID NO: 134725 - RNA, 20 nt, Artificial Sequence
  mmSKRIPTE0005504_Lyn_9
  gRNA
gguuuaacguaagcucccag

SEQ ID NO: 134726 - RNA, 20 nt, Artificial Sequence
  mmSKRIPTE0005505_Xbp1_1
  gRNA
auuggacccagaaaguagcg

SEQ ID NO: 134727 - RNA, 20 nt, Artificial Sequence
  mmSKRIPTE0005506_Xbp1_2
  gRNA
gauccggguggacagccgca

SEQ ID NO: 134728 - RNA, 20 nt, Artificial Sequence
  mmSKRIPTE0005507_Xbp1_3
  gRNA
ucacggauaucgcucuagca

SEQ ID NO: 134729 - RNA, 20 nt, Artificial Sequence
  mmSKRIPTE0005508_Xbp1_4
  gRNA
uccaaccuggcuaaucuccg

SEQ ID NO: 134730 - RNA, 20 nt, Artificial Sequence
  mmSKRIPTE0005509_Xbp1_5
  gRNA
ucuuuagugacggaaccaca

SEQ ID NO: 134731 - RNA, 20 nt, Artificial Sequence
  mmSKRIPTE0005510_Xbp1_6
  gRNA
ggaagaagcauaugacgcaa

SEQ ID NO: 134732 - RNA, 20 nt, Artificial Sequence
  mmSKRIPTE0005511_Xbp1_7
  gRNA
aaccacacggucuaaccgca

SEQ ID NO: 134733 - RNA, 20 nt, Artificial Sequence
  mmSKRIPTE0005512_Xbp1_8
  gRNA
gacagagagucaaacuaacg

SEQ ID NO: 134734 - RNA, 20 nt, Artificial Sequence
  mmSKRIPTE0005513_Xbp1_9
  gRNA
caucccgagaguuuggcuug

SEQ ID NO: 134735 - RNA, 20 nt, Artificial Sequence
  mmSKRIPTE0005514_Irgm2_1
  gRNA
acaccaucaaggguagugua

SEQ ID NO: 134736 - RNA, 20 nt, Artificial Sequence
  mmSKRIPTE0005515_Irgm2_2
  gRNA
cagucggccuaguaaccuca

SEQ ID NO: 134737 - RNA, 20 nt, Artificial Sequence
  mmSKRIPTE0005516_Irgm2_3
  gRNA
gagcaugacagaacacggag

SEQ ID NO: 134738 - RNA, 20 nt, Artificial Sequence
  mmSKRIPTE0005517_Irgm2_4
  gRNA
ugagcccaaacuaaacgcuc

SEQ ID NO: 134739 - RNA, 20 nt, Artificial Sequence
  mmSKRIPTE0005518_Irgm2_5
  gRNA
uuccauguugucgagcaacg

SEQ ID NO: 134740 - RNA, 20 nt, Artificial Sequence
  mmSKRIPTE0005519_Irgm2_6
  gRNA
ucaccuuagcgccaacgacg

SEQ ID NO: 134741 - RNA, 20 nt, Artificial Sequence
  mmSKRIPTE0005520_Irgm2_7
  gRNA
caggguaucagugaggcgca

SEQ ID NO: 134742 - RNA, 20 nt, Artificial Sequence
  mmSKRIPTE0005521_Irgm2_8
  gRNA
cucccugauagcggacacac

SEQ ID NO: 134743 - RNA, 20 nt, Artificial Sequence
  mmSKRIPTE0005522_Irgm2_9
  gRNA
uucguguccgaugagccuaa

SEQ ID NO: 134744 - RNA, 20 nt, Artificial Sequence
  mmSKRIPTE0005523_Med1_1
  gRNA
uuuccgucguagacucagag

SEQ ID NO: 134745 - RNA, 20 nt, Artificial Sequence
  mmSKRIPTE0005524_Med1_2
  gRNA
ccaaacauaacacgucagga

SEQ ID NO: 134746 - RNA, 20 nt, Artificial Sequence
  mmSKRIPTE0005525_Med1_3
  gRNA
gcauucauucccaaagaccg

SEQ ID NO: 134747 - RNA, 20 nt, Artificial Sequence
  mmSKRIPTE0005526_Med1_4
  gRNA
gcuaguguacugacugugag

SEQ ID NO: 134748 - RNA, 20 nt, Artificial Sequence
  mmSKRIPTE0005527_Med1_5
  gRNA
gcggcgagccaauccgagag

SEQ ID NO: 134749 - RNA, 20 nt, Artificial Sequence
  mmSKRIPTE0005528_Med1_6
  gRNA
uauauguaaaccaacccgag

SEQ ID NO: 134750 - RNA, 20 nt, Artificial Sequence
  mmSKRIPTE0005529_Med1_7
  gRNA
guguugguuaucucaccccg

SEQ ID NO: 134751 - RNA, 20 nt, Artificial Sequence
  mmSKRIPTE0005530_Med1_8
  gRNA
uacgcuguaaguaggcccug

SEQ ID NO: 134752 - RNA, 20 nt, Artificial Sequence
  mmSKRIPTE0005531_Med1_9
  gRNA
aacaucgccaguugaucacc

SEQ ID NO: 134753 - RNA, 20 nt, Artificial Sequence
  mmSKRIPTE0005532_Ighg3_1
  gRNA
auggagagccucaugcacca

SEQ ID NO: 134754 - RNA, 20 nt, Artificial Sequence
  mmSKRIPTE0005533_Ighg3_2
  gRNA
uuaaccaggaggucaaguug

SEQ ID NO: 134755 - RNA, 20 nt, Artificial Sequence
  mmSKRIPTE0005534_Ighg3_3
  gRNA
ucagugucuuguaagacccg

SEQ ID NO: 134756 - RNA, 20 nt, Artificial Sequence
  mmSKRIPTE0005535_Ighg3_4
  gRNA
cuguuguacugagcuucacg

SEQ ID NO: 134757 - RNA, 20 nt, Artificial Sequence
  mmSKRIPTE0005536_Ighg3_5
  gRNA
aaggcaucccagugucaccg

SEQ ID NO: 134758 - RNA, 20 nt, Artificial Sequence
  mmSKRIPTE0005537_Ighg3_6
  gRNA
aucggugagaggguaacuaa

SEQ ID NO: 134759 - RNA, 20 nt, Artificial Sequence
  mmSKRIPTE0005538_Ighg3_7
  gRNA
gcauguaggauauaucaccu

SEQ ID NO: 134760 - RNA, 20 nt, Artificial Sequence
  mmSKRIPTE0005539_Ighg3_8
  gRNA
gagacuuaaaugacuuacgu

SEQ ID NO: 134761 - RNA, 20 nt, Artificial Sequence
  mmSKRIPTE0005540_Ighg3_9
  gRNA
cuggcauccuuguaggacca

SEQ ID NO: 134762 - RNA, 20 nt, Artificial Sequence
  mmSKRIPTE0005541_Fgf10_1
  gRNA
agaaggugccaaccgcagag

SEQ ID NO: 134763 - RNA, 20 nt, Artificial Sequence
  mmSKRIPTE0005542_Fgf10_2
  gRNA
acagcaaauagugcagacgu

SEQ ID NO: 134764 - RNA, 20 nt, Artificial Sequence
  mmSKRIPTE0005543_Fgf10_3
  gRNA
ucagggugaacaguggacgu

SEQ ID NO: 134765 - RNA, 20 nt, Artificial Sequence
  mmSKRIPTE0005544_Fgf10_4
  gRNA
agucauaugcucuguacccg

SEQ ID NO: 134766 - RNA, 20 nt, Artificial Sequence
  mmSKRIPTE0005545_Fgf10_5
  gRNA
gaaggguaagaccugcugcg

SEQ ID NO: 134767 - RNA, 20 nt, Artificial Sequence
  mmSKRIPTE0005546_Fgf10_6
  gRNA
gagaacaaaguaacccccgg

SEQ ID NO: 134768 - RNA, 20 nt, Artificial Sequence
  mmSKRIPTE0005547_Fgf10_7
  gRNA
gagcuuuggguguggcacca

SEQ ID NO: 134769 - RNA, 20 nt, Artificial Sequence
  mmSKRIPTE0005548_Fgf10_8
  gRNA
uuuagugaucuacagagcga

SEQ ID NO: 134770 - RNA, 20 nt, Artificial Sequence
  mmSKRIPTE0005549_Fgf10_9
  gRNA
uuauaccugacacaugacca

SEQ ID NO: 134771 - RNA, 20 nt, Artificial Sequence
  mmSKRIPTE0005550_Ccl28_1
  gRNA
uaauccuauaauccaccacc

SEQ ID NO: 134772 - RNA, 20 nt, Artificial Sequence
  mmSKRIPTE0005551_Ccl28_2
  gRNA
ugggcuucuagagucaagug

SEQ ID NO: 134773 - RNA, 20 nt, Artificial Sequence
  mmSKRIPTE0005552_Ccl28_3
  gRNA
ccacauaacucagcgcacug

SEQ ID NO: 134774 - RNA, 20 nt, Artificial Sequence
  mmSKRIPTE0005553_Ccl28_4
  gRNA
gcuucaaaguacgauugugc

SEQ ID NO: 134775 - RNA, 20 nt, Artificial Sequence
  mmSKRIPTE0005554_Ccl28_5
  gRNA
agcacuuggguuguacaugu

SEQ ID NO: 134776 - RNA, 20 nt, Artificial Sequence
  mmSKRIPTE0005555_Ccl28_6
  gRNA
aggaccagucagacaaaccu

SEQ ID NO: 134777 - RNA, 20 nt, Artificial Sequence
  mmSKRIPTE0005556_Ccl28_7
  gRNA
acaggcugguacucugcgga

SEQ ID NO: 134778 - RNA, 20 nt, Artificial Sequence
  mmSKRIPTE0005557_Ccl28_8
  gRNA
gagucauugccagacucagu

SEQ ID NO: 134779 - RNA, 20 nt, Artificial Sequence
  mmSKRIPTE0005558_Ccl28_9
  gRNA
acuauuacuuguuagcuaag

SEQ ID NO: 134780 - RNA, 20 nt, Artificial Sequence
  mmSKRIPTE0005559_Ep300_1
  gRNA
gagaacuugagauuacggau

SEQ ID NO: 134781 - RNA, 20 nt, Artificial Sequence
  mmSKRIPTE0005560_Ep300_2
  gRNA
ugggagcaggacaagcgaug

SEQ ID NO: 134782 - RNA, 20 nt, Artificial Sequence
  mmSKRIPTE0005561_Ep300_3
  gRNA
augucucaaacugcguguug

SEQ ID NO: 134783 - RNA, 20 nt, Artificial Sequence
  mmSKRIPTE0005562_Ep300_4
  gRNA
uguaguaaguagcaucacgg

SEQ ID NO: 134784 - RNA, 20 nt, Artificial Sequence
  mmSKRIPTE0005563_Ep300_5
  gRNA
ucgagaucuggauugcacgu

SEQ ID NO: 134785 - RNA, 20 nt, Artificial Sequence
  mmSKRIPTE0005564_Ep300_6
  gRNA
ggaagaaaugaacacuaucg

SEQ ID NO: 134786 - RNA, 20 nt, Artificial Sequence
  mmSKRIPTE0005565_Ep300_7
  gRNA
cagauggccagaugaucucg

SEQ ID NO: 134787 - RNA, 20 nt, Artificial Sequence
  mmSKRIPTE0005566_Ep300_8
  gRNA
ucggcaagaaggccauacug

SEQ ID NO: 134788 - RNA, 20 nt, Artificial Sequence
  mmSKRIPTE0005567_Ep300_9
  gRNA
cagcaugcaacgaacuggug

SEQ ID NO: 134789 - RNA, 20 nt, Artificial Sequence
  mmSKRIPTE0005568_App_1
  gRNA
cgguuagcguacgcuuacag

SEQ ID NO: 134790 - RNA, 20 nt, Artificial Sequence
  mmSKRIPTE0005569_App_2
  gRNA
ccccaacuucugacaccacg

SEQ ID NO: 134791 - RNA, 20 nt, Artificial Sequence
  mmSKRIPTE0005570_App_3
  gRNA
aucucucggagaacauccga

SEQ ID NO: 134792 - RNA, 20 nt, Artificial Sequence
  mmSKRIPTE0005571_App_4
  gRNA
ucuggccagacgcaaucucg

SEQ ID NO: 134793 - RNA, 20 nt, Artificial Sequence
  mmSKRIPTE0005572_App_5
  gRNA
guaacacgugcaacccagag

SEQ ID NO: 134794 - RNA, 20 nt, Artificial Sequence
  mmSKRIPTE0005573_App_6
  gRNA
cuggcggucacacuaacgga

SEQ ID NO: 134795 - RNA, 20 nt, Artificial Sequence
  mmSKRIPTE0005574_App_7
  gRNA
uguacaacgcguaggcaccu

SEQ ID NO: 134796 - RNA, 20 nt, Artificial Sequence
  mmSKRIPTE0005575_App_8
  gRNA
uuaaguaggaacucuaucug

SEQ ID NO: 134797 - RNA, 20 nt, Artificial Sequence
  mmSKRIPTE0005576_App_9
  gRNA
ucccacgcacucaugagggu

SEQ ID NO: 134798 - RNA, 20 nt, Artificial Sequence
  mmSKRIPTE0005577_Tap1_1
  gRNA
augcaccgagguuagacccg

SEQ ID NO: 134799 - RNA, 20 nt, Artificial Sequence
  mmSKRIPTE0005578_Tap1_2
  gRNA
caggcggaggaugcgcaaag

SEQ ID NO: 134800 - RNA, 20 nt, Artificial Sequence
  mmSKRIPTE0005579_Tap1_3
  gRNA
ucuggacagcucacgcucga

SEQ ID NO: 134801 - RNA, 20 nt, Artificial Sequence
  mmSKRIPTE0005580_Tap1_4
  gRNA
acuaauggacucgcacacgu

SEQ ID NO: 134802 - RNA, 20 nt, Artificial Sequence
  mmSKRIPTE0005581_Tap1_5
  gRNA
uaucggcgaugccuacugug

SEQ ID NO: 134803 - RNA, 20 nt, Artificial Sequence
  mmSKRIPTE0005582_Tap1_6
  gRNA
cgugucuagugauucgaggu

SEQ ID NO: 134804 - RNA, 20 nt, Artificial Sequence
  mmSKRIPTE0005583_Tap1_7
  gRNA
gccauacuucuagguagaag

SEQ ID NO: 134805 - RNA, 20 nt, Artificial Sequence
  mmSKRIPTE0005584_Tap1_8
  gRNA
ggacaccuagguuagcugcg

SEQ ID NO: 134806 - RNA, 20 nt, Artificial Sequence
  mmSKRIPTE0005585_Tap1_9
  gRNA
gccuggggaacacuccggga

SEQ ID NO: 134807 - RNA, 20 nt, Artificial Sequence
  mmSKRIPTE0005586_Blnk_1
  gRNA
aggugcuucccuagucgagg

SEQ ID NO: 134808 - RNA, 20 nt, Artificial Sequence
  mmSKRIPTE0005587_Blnk_2
  gRNA
gacggccaaucauaggugga

SEQ ID NO: 134809 - RNA, 20 nt, Artificial Sequence
  mmSKRIPTE0005588_Blnk_3
  gRNA
aagguguaggaggcguucag

SEQ ID NO: 134810 - RNA, 20 nt, Artificial Sequence
  mmSKRIPTE0005589_Blnk_4
  gRNA
cuaugcaggucgaaacagug

SEQ ID NO: 134811 - RNA, 20 nt, Artificial Sequence
  mmSKRIPTE0005590_Blnk_5
  gRNA
uauaauggcagcaguccgcu

SEQ ID NO: 134812 - RNA, 20 nt, Artificial Sequence
  mmSKRIPTE0005591_Blnk_6
  gRNA
acgggagucuacguuaagag

SEQ ID NO: 134813 - RNA, 20 nt, Artificial Sequence
  mmSKRIPTE0005592_Blnk_7
  gRNA
aagaggaauaaggcuccgaa

SEQ ID NO: 134814 - RNA, 20 nt, Artificial Sequence
  mmSKRIPTE0005593_Blnk_8
  gRNA
ccugggucauggaugccuag

SEQ ID NO: 134815 - RNA, 20 nt, Artificial Sequence
  mmSKRIPTE0005594_Blnk_9
  gRNA
gggaagacauccgaucaaag

SEQ ID NO: 134816 - RNA, 20 nt, Artificial Sequence
  mmSKRIPTE0005595_Hps1_1
  gRNA
ggauauauaagaccacuacg

SEQ ID NO: 134817 - RNA, 20 nt, Artificial Sequence
  mmSKRIPTE0005596_Hps1_2
  gRNA
cgagacgcuagagcggcacg

SEQ ID NO: 134818 - RNA, 20 nt, Artificial Sequence
  mmSKRIPTE0005597_Hps1_3
  gRNA
caacacuuggagucuaucga

SEQ ID NO: 134819 - RNA, 20 nt, Artificial Sequence
  mmSKRIPTE0005598_Hps1_4
  gRNA
gcucauccccggaagaugag

SEQ ID NO: 134820 - RNA, 20 nt, Artificial Sequence
  mmSKRIPTE0005599_Hps1_5
  gRNA
ucuacuccggguaaaccuga

SEQ ID NO: 134821 - RNA, 20 nt, Artificial Sequence
  mmSKRIPTE0005600_Hps1_6
  gRNA
ggaccuagcaccaggcacgu

SEQ ID NO: 134822 - RNA, 20 nt, Artificial Sequence
  mmSKRIPTE0005601_Hps1_7
  gRNA
ugggagcuauaagucgggca

SEQ ID NO: 134823 - RNA, 20 nt, Artificial Sequence
  mmSKRIPTE0005602_Hps1_8
  gRNA
agugggugacaagugaaacg

SEQ ID NO: 134824 - RNA, 20 nt, Artificial Sequence
  mmSKRIPTE0005603_Hps1_9
  gRNA
gguggguuaacuaggcacac

SEQ ID NO: 134825 - RNA, 20 nt, Artificial Sequence
  mmSKRIPTE0005604_Mmp9_1
  gRNA
gccauucgaacaccacgcug

SEQ ID NO: 134826 - RNA, 20 nt, Artificial Sequence
  mmSKRIPTE0005605_Mmp9_2
  gRNA
ccuuccuuacugcccgcacg

SEQ ID NO: 134827 - RNA, 20 nt, Artificial Sequence
  mmSKRIPTE0005606_Mmp9_3
  gRNA
acgaucgcuucaaaacacac

SEQ ID NO: 134828 - RNA, 20 nt, Artificial Sequence
  mmSKRIPTE0005607_Mmp9_4
  gRNA
gugaaaagccagcgucgaug

SEQ ID NO: 134829 - RNA, 20 nt, Artificial Sequence
  mmSKRIPTE0005608_Mmp9_5
  gRNA
ggucaguagacacuaaggug

SEQ ID NO: 134830 - RNA, 20 nt, Artificial Sequence
  mmSKRIPTE0005609_Mmp9_6
  gRNA
agagccuucccgagacgacg

SEQ ID NO: 134831 - RNA, 20 nt, Artificial Sequence
  mmSKRIPTE0005610_Mmp9_7
  gRNA
cccaauugggagucaaggag

SEQ ID NO: 134832 - RNA, 20 nt, Artificial Sequence
  mmSKRIPTE0005611_Mmp9_8
  gRNA
guaccgcuaugguuacaccc

SEQ ID NO: 134833 - RNA, 20 nt, Artificial Sequence
  mmSKRIPTE0005612_Mmp9_9
  gRNA
cuccgguuagcugaacacaa

SEQ ID NO: 134834 - RNA, 20 nt, Artificial Sequence
  mmSKRIPTE0005613_Il21_1
  gRNA
acaauguccauguucacccg

SEQ ID NO: 134835 - RNA, 20 nt, Artificial Sequence
  mmSKRIPTE0005614_Il21_2
  gRNA
ucuccacuugcaaucccaag

SEQ ID NO: 134836 - RNA, 20 nt, Artificial Sequence
  mmSKRIPTE0005615_Il21_3
  gRNA
ugccugcccauguagcauaa

SEQ ID NO: 134837 - RNA, 20 nt, Artificial Sequence
  mmSKRIPTE0005616_Il21_4
  gRNA
ggugcuaaucuggucccuag

SEQ ID NO: 134838 - RNA, 20 nt, Artificial Sequence
  mmSKRIPTE0005617_Il21_5
  gRNA
gaugcugaugaaucaucugu

SEQ ID NO: 134839 - RNA, 20 nt, Artificial Sequence
  mmSKRIPTE0005618_Il21_6
  gRNA
gaguaacucugcaagaaggu

SEQ ID NO: 134840 - RNA, 20 nt, Artificial Sequence
  mmSKRIPTE0005619_Il21_7
  gRNA
cugcuuaguuaaugggcgaa

SEQ ID NO: 134841 - RNA, 20 nt, Artificial Sequence
  mmSKRIPTE0005620_Il21_8
  gRNA
ucgugagcgucuauaguguc

SEQ ID NO: 134842 - RNA, 20 nt, Artificial Sequence
  mmSKRIPTE0005621_Il21_9
  gRNA
aggauccgagaagauucccg

SEQ ID NO: 134843 - RNA, 20 nt, Artificial Sequence
  mmSKRIPTE0005622_Zbtb7b_1
  gRNA
cugucacaagauaauccacg

SEQ ID NO: 134844 - RNA, 20 nt, Artificial Sequence
  mmSKRIPTE0005623_Zbtb7b_2
  gRNA
aaggcgccgcaaggaugacg

SEQ ID NO: 134845 - RNA, 20 nt, Artificial Sequence
  mmSKRIPTE0005624_Zbtb7b_3
  gRNA
uggccguaaauuaugcaaag

SEQ ID NO: 134846 - RNA, 20 nt, Artificial Sequence
  mmSKRIPTE0005625_Zbtb7b_4
  gRNA
gcaauggggaaaccgcagug

SEQ ID NO: 134847 - RNA, 20 nt, Artificial Sequence
  mmSKRIPTE0005626_Zbtb7b_5
  gRNA
ggacaccacgccaagcaacg

SEQ ID NO: 134848 - RNA, 20 nt, Artificial Sequence
  mmSKRIPTE0005627_Zbtb7b_6
  gRNA
guucgauucugauaccaaca

SEQ ID NO: 134849 - RNA, 20 nt, Artificial Sequence
  mmSKRIPTE0005628_Zbtb7b_7
  gRNA
cgacgggcaacaggucgagg

SEQ ID NO: 134850 - RNA, 20 nt, Artificial Sequence
  mmSKRIPTE0005629_Zbtb7b_8
  gRNA
gaaacccgcauagccgaagu

SEQ ID NO: 134851 - RNA, 20 nt, Artificial Sequence
  mmSKRIPTE0005630_Zbtb7b_9
  gRNA
gucauuccuaguacgagcag

SEQ ID NO: 134852 - RNA, 20 nt, Artificial Sequence
  mmSKRIPTE0005631_Pum1_1
  gRNA
cucuaacacugcgagcaccu

SEQ ID NO: 134853 - RNA, 20 nt, Artificial Sequence
  mmSKRIPTE0005632_Pum1_2
  gRNA
gcuuugucuacgcacccgua

SEQ ID NO: 134854 - RNA, 20 nt, Artificial Sequence
  mmSKRIPTE0005633_Pum1_3
  gRNA
gcacaacguuaggcggagaa

SEQ ID NO: 134855 - RNA, 20 nt, Artificial Sequence
  mmSKRIPTE0005634_Pum1_4
  gRNA
gccucccaaacacguacgag

SEQ ID NO: 134856 - RNA, 20 nt, Artificial Sequence
  mmSKRIPTE0005635_Pum1_5
  gRNA
aggcccuauuguuauccgcg

SEQ ID NO: 134857 - RNA, 20 nt, Artificial Sequence
  mmSKRIPTE0005636_Pum1_6
  gRNA
cauuccauaucgcaaacgag

SEQ ID NO: 134858 - RNA, 20 nt, Artificial Sequence
  mmSKRIPTE0005637_Pum1_7
  gRNA
guccaccauagcgucguccu

SEQ ID NO: 134859 - RNA, 20 nt, Artificial Sequence
  mmSKRIPTE0005638_Pum1_8
  gRNA
ugccaagacuggauaaccug

SEQ ID NO: 134860 - RNA, 20 nt, Artificial Sequence
  mmSKRIPTE0005639_Pum1_9
  gRNA
cugccaaacgccaauacgag

SEQ ID NO: 134861 - RNA, 20 nt, Artificial Sequence
  mmSKRIPTE0005640_Oasl2_1
  gRNA
ccacgugacuuacggcucug

SEQ ID NO: 134862 - RNA, 20 nt, Artificial Sequence
  mmSKRIPTE0005641_Oasl2_2
  gRNA
uagauugauugauacucgga

SEQ ID NO: 134863 - RNA, 20 nt, Artificial Sequence
  mmSKRIPTE0005642_Oasl2_3
  gRNA
guaccugauccuccgcacaa

SEQ ID NO: 134864 - RNA, 20 nt, Artificial Sequence
  mmSKRIPTE0005643_Oasl2_4
  gRNA
uccagcugcagggcccaucg

SEQ ID NO: 134865 - RNA, 20 nt, Artificial Sequence
  mmSKRIPTE0005644_Oasl2_5
  gRNA
uacaugggcugauggcacgg

SEQ ID NO: 134866 - RNA, 20 nt, Artificial Sequence
  mmSKRIPTE0005645_Oasl2_6
  gRNA
ucgagcgauaggguuaggcu

SEQ ID NO: 134867 - RNA, 20 nt, Artificial Sequence
  mmSKRIPTE0005646_Oasl2_7
  gRNA
gaggucgguaguuaggaaug

SEQ ID NO: 134868 - RNA, 20 nt, Artificial Sequence
  mmSKRIPTE0005647_Oasl2_8
  gRNA
gaggcguaagacucuaggca

SEQ ID NO: 134869 - RNA, 20 nt, Artificial Sequence
  mmSKRIPTE0005648_Oasl2_9
  gRNA
cugggagacauaacgaacaa

SEQ ID NO: 134870 - RNA, 20 nt, Artificial Sequence
  mmSKRIPTE0005649_Ccl26_1
  gRNA
accaugcugccccuccagcg

SEQ ID NO: 134871 - RNA, 20 nt, Artificial Sequence
  mmSKRIPTE0005650_Ccl26_2
  gRNA
gaauucaucagguuccauga

SEQ ID NO: 134872 - RNA, 20 nt, Artificial Sequence
  mmSKRIPTE0005651_Ccl26_3
  gRNA
gagaaccagcuacauacaug

SEQ ID NO: 134873 - RNA, 20 nt, Artificial Sequence
  mmSKRIPTE0005652_Ccl26_4
  gRNA
ucggccacaucauugagcaa

SEQ ID NO: 134874 - RNA, 20 nt, Artificial Sequence
  mmSKRIPTE0005653_Ccl26_5
  gRNA
gcaauucuguguccagccag

SEQ ID NO: 134875 - RNA, 20 nt, Artificial Sequence
  mmSKRIPTE0005654_Ccl26_6
  gRNA
ugucugacaagaccauccca

SEQ ID NO: 134876 - RNA, 20 nt, Artificial Sequence
  mmSKRIPTE0005655_Ccl26_7
  gRNA
aacuagaacagacuauaacc

SEQ ID NO: 134877 - RNA, 20 nt, Artificial Sequence
  mmSKRIPTE0005656_Ccl26_8
  gRNA
caggaguugugacaggaaug

SEQ ID NO: 134878 - RNA, 20 nt, Artificial Sequence
  mmSKRIPTE0005657_Ccl26_9
  gRNA
augagggcaugaguaggcag

SEQ ID NO: 134879 - RNA, 20 nt, Artificial Sequence
  mmSKRIPTE0005658_Gimap1_1
  gRNA
uaaacccuuccuuguagacg

SEQ ID NO: 134880 - RNA, 20 nt, Artificial Sequence
  mmSKRIPTE0005659_Gimap1_2
  gRNA
cuucugcacucacaagcgaa

SEQ ID NO: 134881 - RNA, 20 nt, Artificial Sequence
  mmSKRIPTE0005660_Gimap1_3
  gRNA
ugagcauagaggaagucgcu

SEQ ID NO: 134882 - RNA, 20 nt, Artificial Sequence
  mmSKRIPTE0005661_Gimap1_4
  gRNA
augcggaccaucaagcacag

SEQ ID NO: 134883 - RNA, 20 nt, Artificial Sequence
  mmSKRIPTE0005662_Gimap1_5
  gRNA
cguguucccuguguaaacgc

SEQ ID NO: 134884 - RNA, 20 nt, Artificial Sequence
  mmSKRIPTE0005663_Gimap1_6
  gRNA
gagcuggcuugagacaagcg

SEQ ID NO: 134885 - RNA, 20 nt, Artificial Sequence
  mmSKRIPTE0005664_Gimap1_7
  gRNA
gggcgcgcacuacuccaaug

SEQ ID NO: 134886 - RNA, 20 nt, Artificial Sequence
  mmSKRIPTE0005665_Gimap1_8
  gRNA
ucuucagcuccgagaucccg

SEQ ID NO: 134887 - RNA, 20 nt, Artificial Sequence
  mmSKRIPTE0005666_Gimap1_9
  gRNA
uuaucgcccgagauuucacu

SEQ ID NO: 134888 - RNA, 20 nt, Artificial Sequence
  mmSKRIPTE0005667_Aicda_1
  gRNA
aagucaucgacuucguacaa

SEQ ID NO: 134889 - RNA, 20 nt, Artificial Sequence
  mmSKRIPTE0005668_Aicda_2
  gRNA
uucacagaaguagaggcgcg

SEQ ID NO: 134890 - RNA, 20 nt, Artificial Sequence
  mmSKRIPTE0005669_Aicda_3
  gRNA
aggaggugaaccaggugacg

SEQ ID NO: 134891 - RNA, 20 nt, Artificial Sequence
  mmSKRIPTE0005670_Aicda_4
  gRNA
ucccgaucuggaccccagcg

SEQ ID NO: 134892 - RNA, 20 nt, Artificial Sequence
  mmSKRIPTE0005671_Aicda_5
  gRNA
ggaaagugucuaaacgaagu

SEQ ID NO: 134893 - RNA, 20 nt, Artificial Sequence
  mmSKRIPTE0005672_Aicda_6
  gRNA
caggcacuuccgggacacga

SEQ ID NO: 134894 - RNA, 20 nt, Artificial Sequence
  mmSKRIPTE0005673_Aicda_7
  gRNA
ccgcugacacucacucugag

SEQ ID NO: 134895 - RNA, 20 nt, Artificial Sequence
  mmSKRIPTE0005674_Aicda_8
  gRNA
auuauucuggcgccaccuag

SEQ ID NO: 134896 - RNA, 20 nt, Artificial Sequence
  mmSKRIPTE0005675_Aicda_9
  gRNA
guaggaacaacaauuccacg

SEQ ID NO: 134897 - RNA, 20 nt, Artificial Sequence
  mmSKRIPTE0005676_Trim28_1
  gRNA
cggcgccgucgucuguacag

SEQ ID NO: 134898 - RNA, 20 nt, Artificial Sequence
  mmSKRIPTE0005677_Trim28_2
  gRNA
uuaagaauacacacgugagu

SEQ ID NO: 134899 - RNA, 20 nt, Artificial Sequence
  mmSKRIPTE0005678_Trim28_3
  gRNA
guuaccaggucuggacaccg

SEQ ID NO: 134900 - RNA, 20 nt, Artificial Sequence
  mmSKRIPTE0005679_Trim28_4
  gRNA
gucaggucuaggguaccacc

SEQ ID NO: 134901 - RNA, 20 nt, Artificial Sequence
  mmSKRIPTE0005680_Trim28_5
  gRNA
auggacaagacaaucaagca

SEQ ID NO: 134902 - RNA, 20 nt, Artificial Sequence
  mmSKRIPTE0005681_Trim28_6
  gRNA
gcgccugugcgagaguaugg

SEQ ID NO: 134903 - RNA, 20 nt, Artificial Sequence
  mmSKRIPTE0005682_Trim28_7
  gRNA
ucgguagccagcugaugcaa

SEQ ID NO: 134904 - RNA, 20 nt, Artificial Sequence
  mmSKRIPTE0005683_Trim28_8
  gRNA
caggaaguucccgccgaacg

SEQ ID NO: 134905 - RNA, 20 nt, Artificial Sequence
  mmSKRIPTE0005684_Trim28_9
  gRNA
cgccgcagcgaauaauucgg

SEQ ID NO: 134906 - RNA, 20 nt, Artificial Sequence
  mmSKRIPTE0005685_Igf2_1
  gRNA
gacaccuggagacaguccgc

SEQ ID NO: 134907 - RNA, 20 nt, Artificial Sequence
  mmSKRIPTE0005686_Igf2_2
  gRNA
uugggugguaacacgaucag

SEQ ID NO: 134908 - RNA, 20 nt, Artificial Sequence
  mmSKRIPTE0005687_Igf2_3
  gRNA
gagauuacgaccuugcccgg

SEQ ID NO: 134909 - RNA, 20 nt, Artificial Sequence
  mmSKRIPTE0005688_Igf2_4
  gRNA
cguacuuccgguagguagcg

SEQ ID NO: 134910 - RNA, 20 nt, Artificial Sequence
  mmSKRIPTE0005689_Igf2_5
  gRNA
uggggugacaauuaguacac

SEQ ID NO: 134911 - RNA, 20 nt, Artificial Sequence
  mmSKRIPTE0005690_Igf2_6
  gRNA
guugcuggacaucuccgaag

SEQ ID NO: 134912 - RNA, 20 nt, Artificial Sequence
  mmSKRIPTE0005691_Igf2_7
  gRNA
cggagagacucugugcggag

SEQ ID NO: 134913 - RNA, 20 nt, Artificial Sequence
  mmSKRIPTE0005692_Igf2_8
  gRNA
aagcccaaccucggaccgug

SEQ ID NO: 134914 - RNA, 20 nt, Artificial Sequence
  mmSKRIPTE0005693_Igf2_9
  gRNA
caguuugucuguucggaccg

SEQ ID NO: 134915 - RNA, 20 nt, Artificial Sequence
  mmSKRIPTE0005694_Ubash3b_1
  gRNA
uauccgguuugcuaaccaug

SEQ ID NO: 134916 - RNA, 20 nt, Artificial Sequence
  mmSKRIPTE0005695_Ubash3b_2
  gRNA
ucauccccgcugcacaagcg

SEQ ID NO: 134917 - RNA, 20 nt, Artificial Sequence
  mmSKRIPTE0005696_Ubash3b_3
  gRNA
gcuaaggauccgaccaccgu

SEQ ID NO: 134918 - RNA, 20 nt, Artificial Sequence
  mmSKRIPTE0005697_Ubash3b_4
  gRNA
aaauagcacaaagggcugcg

SEQ ID NO: 134919 - RNA, 20 nt, Artificial Sequence
  mmSKRIPTE0005698_Ubash3b_5
  gRNA
aaagcguguuugcacccccg

SEQ ID NO: 134920 - RNA, 20 nt, Artificial Sequence
  mmSKRIPTE0005699_Ubash3b_6
  gRNA
gcugagugugcacugcuacg

SEQ ID NO: 134921 - RNA, 20 nt, Artificial Sequence
  mmSKRIPTE0005700_Ubash3b_7
  gRNA
ccaacaucaucaugaccucg

SEQ ID NO: 134922 - RNA, 20 nt, Artificial Sequence
  mmSKRIPTE0005701_Ubash3b_8
  gRNA
cgucaagcuaggaugcgacu

SEQ ID NO: 134923 - RNA, 20 nt, Artificial Sequence
  mmSKRIPTE0005702_Ubash3b_9
  gRNA
uaugugcagucugaacgcag

SEQ ID NO: 134924 - RNA, 20 nt, Artificial Sequence
  mmSKRIPTE0005703_G6pdx_1
  gRNA
gcgcgcaucaaagggacucg

SEQ ID NO: 134925 - RNA, 20 nt, Artificial Sequence
  mmSKRIPTE0005704_G6pdx_2
  gRNA
uugcgaucucgaaauuguag

SEQ ID NO: 134926 - RNA, 20 nt, Artificial Sequence
  mmSKRIPTE0005705_G6pdx_3
  gRNA
aggcuggaaccgcaucaucg

SEQ ID NO: 134927 - RNA, 20 nt, Artificial Sequence
  mmSKRIPTE0005706_G6pdx_4
  gRNA
augggcagccuccuuaccaa

SEQ ID NO: 134928 - RNA, 20 nt, Artificial Sequence
  mmSKRIPTE0005707_G6pdx_5
  gRNA
uagauauauuucuagcugag

SEQ ID NO: 134929 - RNA, 20 nt, Artificial Sequence
  mmSKRIPTE0005708_G6pdx_6
  gRNA
gaugaguagaugacacugcu

SEQ ID NO: 134930 - RNA, 20 nt, Artificial Sequence
  mmSKRIPTE0005709_G6pdx_7
  gRNA
cagauacagccacuauacug

SEQ ID NO: 134931 - RNA, 20 nt, Artificial Sequence
  mmSKRIPTE0005710_G6pdx_8
  gRNA
cuuuggaagauauggcaaag

SEQ ID NO: 134932 - RNA, 20 nt, Artificial Sequence
  mmSKRIPTE0005711_G6pdx_9
  gRNA
gauguccgugaugagaaggu

SEQ ID NO: 134933 - RNA, 20 nt, Artificial Sequence
  mmSKRIPTE0005712_Pigr_1
  gRNA
cucgccaugagguaccgugg

SEQ ID NO: 134934 - RNA, 20 nt, Artificial Sequence
  mmSKRIPTE0005713_Pigr_2
  gRNA
acuguuaguuauacccagcg

SEQ ID NO: 134935 - RNA, 20 nt, Artificial Sequence
  mmSKRIPTE0005714_Pigr_3
  gRNA
caggaaaggcgauucucaug

SEQ ID NO: 134936 - RNA, 20 nt, Artificial Sequence
  mmSKRIPTE0005715_Pigr_4
  gRNA
uggcugcuagaggauccagu

SEQ ID NO: 134937 - RNA, 20 nt, Artificial Sequence
  mmSKRIPTE0005716_Pigr_5
  gRNA
cguaggagaaaaguugcuug

SEQ ID NO: 134938 - RNA, 20 nt, Artificial Sequence
  mmSKRIPTE0005717_Pigr_6
  gRNA
uggguuacaggaaaaucacg

SEQ ID NO: 134939 - RNA, 20 nt, Artificial Sequence
  mmSKRIPTE0005718_Pigr_7
  gRNA
ugguagucacgauuucugca

SEQ ID NO: 134940 - RNA, 20 nt, Artificial Sequence
  mmSKRIPTE0005719_Pigr_8
  gRNA
aggucuugaagacagaucgu

SEQ ID NO: 134941 - RNA, 20 nt, Artificial Sequence
  mmSKRIPTE0005720_Pigr_9
  gRNA
ggguggccagaguccgacau

SEQ ID NO: 134942 - RNA, 20 nt, Artificial Sequence
  mmSKRIPTE0005721_Prtn3_1
  gRNA
ggcgcauucgcggaucacga

SEQ ID NO: 134943 - RNA, 20 nt, Artificial Sequence
  mmSKRIPTE0005722_Prtn3_2
  gRNA
uggauucaaaacgugcugcg

SEQ ID NO: 134944 - RNA, 20 nt, Artificial Sequence
  mmSKRIPTE0005723_Prtn3_3
  gRNA
ggaacacaacgugugcacgc

SEQ ID NO: 134945 - RNA, 20 nt, Artificial Sequence
  mmSKRIPTE0005724_Prtn3_4
  gRNA
ucccccagugagcgacuagg

SEQ ID NO: 134946 - RNA, 20 nt, Artificial Sequence
  mmSKRIPTE0005725_Prtn3_5
  gRNA
cugcugcacuccaagcgccg

SEQ ID NO: 134947 - RNA, 20 nt, Artificial Sequence
  mmSKRIPTE0005726_Prtn3_6
  gRNA
agcuguugauauguccggca

SEQ ID NO: 134948 - RNA, 20 nt, Artificial Sequence
  mmSKRIPTE0005727_Prtn3_7
  gRNA
ccauggagccgucauagugu

SEQ ID NO: 134949 - RNA, 20 nt, Artificial Sequence
  mmSKRIPTE0005728_Prtn3_8
  gRNA
auagaucccaagucuaugcg

SEQ ID NO: 134950 - RNA, 20 nt, Artificial Sequence
  mmSKRIPTE0005729_Prtn3_9
  gRNA
gaggccuggacugcgccuag

SEQ ID NO: 134951 - RNA, 20 nt, Artificial Sequence
  mmSKRIPTE0005730_Kitl_1
  gRNA
uacaugaauuuagcuaccgg

SEQ ID NO: 134952 - RNA, 20 nt, Artificial Sequence
  mmSKRIPTE0005731_Kitl_2
  gRNA
agugacggcugcaauucuug

SEQ ID NO: 134953 - RNA, 20 nt, Artificial Sequence
  mmSKRIPTE0005732_Kitl_3
  gRNA
gaacugcauaaccuagacuu

SEQ ID NO: 134954 - RNA, 20 nt, Artificial Sequence
  mmSKRIPTE0005733_Kitl_4
  gRNA
acauuguuaccuucgcacag

SEQ ID NO: 134955 - RNA, 20 nt, Artificial Sequence
  mmSKRIPTE0005734_Kitl_5
  gRNA
ccuuggccguugcuuucccg

SEQ ID NO: 134956 - RNA, 20 nt, Artificial Sequence
  mmSKRIPTE0005735_Kitl_6
  gRNA
aaaucgcuccgggagccccg

SEQ ID NO: 134957 - RNA, 20 nt, Artificial Sequence
  mmSKRIPTE0005736_Kitl_7
  gRNA
ccucaacuaugucgccggga

SEQ ID NO: 134958 - RNA, 20 nt, Artificial Sequence
  mmSKRIPTE0005737_Kitl_8
  gRNA
ucucguagccaacaaugacu

SEQ ID NO: 134959 - RNA, 20 nt, Artificial Sequence
  mmSKRIPTE0005738_Kitl_9
  gRNA
aagguguacgcaucucccau

SEQ ID NO: 134960 - RNA, 20 nt, Artificial Sequence
  mmSKRIPTE0005739_Ikzf3_1
  gRNA
gcucaccuuccaugucgccg

SEQ ID NO: 134961 - RNA, 20 nt, Artificial Sequence
  mmSKRIPTE0005740_Ikzf3_2
  gRNA
gcagucguguauacacgagc

SEQ ID NO: 134962 - RNA, 20 nt, Artificial Sequence
  mmSKRIPTE0005741_Ikzf3_3
  gRNA
cagagaccggcauuaccugu

SEQ ID NO: 134963 - RNA, 20 nt, Artificial Sequence
  mmSKRIPTE0005742_Ikzf3_4
  gRNA
auuccguggcaacaauucug

SEQ ID NO: 134964 - RNA, 20 nt, Artificial Sequence
  mmSKRIPTE0005743_Ikzf3_5
  gRNA
uguagcaggugcuuaagccg

SEQ ID NO: 134965 - RNA, 20 nt, Artificial Sequence
  mmSKRIPTE0005744_Ikzf3_6
  gRNA
agguucacccuugugaccgu

SEQ ID NO: 134966 - RNA, 20 nt, Artificial Sequence
  mmSKRIPTE0005745_Ikzf3_7
  gRNA
ugggcggcucuuccgcugug

SEQ ID NO: 134967 - RNA, 20 nt, Artificial Sequence
  mmSKRIPTE0005746_Ikzf3_8
  gRNA
cagugugcaggugucacgcg

SEQ ID NO: 134968 - RNA, 20 nt, Artificial Sequence
  mmSKRIPTE0005747_Ikzf3_9
  gRNA
guuccaguguaaucagugcg

SEQ ID NO: 134969 - RNA, 20 nt, Artificial Sequence
  mmSKRIPTE0005748_Ighv3-4_1
  gRNA
cugguggaacuggauccggc

SEQ ID NO: 134970 - RNA, 20 nt, Artificial Sequence
  mmSKRIPTE0005749_Ighv3-4_2
  gRNA
gagauuccacaguccaggag

SEQ ID NO: 134971 - RNA, 20 nt, Artificial Sequence
  mmSKRIPTE0005750_Ighv3-4_3
  gRNA
aguggcaacacuuaccagga

SEQ ID NO: 134972 - RNA, 20 nt, Artificial Sequence
  mmSKRIPTE0005751_Ighv3-4_4
  gRNA
acaggaaaucuacauuaggg

SEQ ID NO: 134973 - RNA, 20 nt, Artificial Sequence
  mmSKRIPTE0005752_Ighv3-4_5
  gRNA
ugucugagaaggcuucacca

SEQ ID NO: 134974 - RNA, 20 nt, Artificial Sequence
  mmSKRIPTE0005753_Ighv3-4_6
  gRNA
ggagcgugaucucucaagga

SEQ ID NO: 134975 - RNA, 20 nt, Artificial Sequence
  mmSKRIPTE0005754_Ighv3-4_7
  gRNA
cuugucuucauaauugggga

SEQ ID NO: 134976 - RNA, 20 nt, Artificial Sequence
  mmSKRIPTE0005755_Ighv3-4_8
  gRNA
uguagagaugcucuauaagg

SEQ ID NO: 134977 - RNA, 20 nt, Artificial Sequence
  mmSKRIPTE0005756_Ighv3-4_9
  gRNA
auaggguacauaagcuccag

SEQ ID NO: 134978 - RNA, 20 nt, Artificial Sequence
  mmSKRIPTE0005757_Blk_1
  gRNA
agccagugaaagguggaccg

SEQ ID NO: 134979 - RNA, 20 nt, Artificial Sequence
  mmSKRIPTE0005758_Blk_2
  gRNA
gacugauuucgggacuaucg

SEQ ID NO: 134980 - RNA, 20 nt, Artificial Sequence
  mmSKRIPTE0005759_Blk_3
  gRNA
acaucucaggaucgacuuag

SEQ ID NO: 134981 - RNA, 20 nt, Artificial Sequence
  mmSKRIPTE0005760_Blk_4
  gRNA
gcugguucgucucuacgcug

SEQ ID NO: 134982 - RNA, 20 nt, Artificial Sequence
  mmSKRIPTE0005761_Blk_5
  gRNA
gugguugaagaacuuucuag

SEQ ID NO: 134983 - RNA, 20 nt, Artificial Sequence
  mmSKRIPTE0005762_Blk_6
  gRNA
uaugggcgcguucccuaccc

SEQ ID NO: 134984 - RNA, 20 nt, Artificial Sequence
  mmSKRIPTE0005763_Blk_7
  gRNA
cuuccucagaaacaccuccg

SEQ ID NO: 134985 - RNA, 20 nt, Artificial Sequence
  mmSKRIPTE0005764_Blk_8
  gRNA
auaucauuguacaacuccgg

SEQ ID NO: 134986 - RNA, 20 nt, Artificial Sequence
  mmSKRIPTE0005765_Blk_9
  gRNA
cuucaggaccaucagccgga

SEQ ID NO: 134987 - RNA, 20 nt, Artificial Sequence
  mmSKRIPTE0005766_Plg_1
  gRNA
uuauugccgcaacccugacg

SEQ ID NO: 134988 - RNA, 20 nt, Artificial Sequence
  mmSKRIPTE0005767_Plg_2
  gRNA
agcgaugggcagagcuaucg

SEQ ID NO: 134989 - RNA, 20 nt, Artificial Sequence
  mmSKRIPTE0005768_Plg_3
  gRNA
cugagguuucccgcacucaa

SEQ ID NO: 134990 - RNA, 20 nt, Artificial Sequence
  mmSKRIPTE0005769_Plg_4
  gRNA
ggaagaggugaaaauuaccg

SEQ ID NO: 134991 - RNA, 20 nt, Artificial Sequence
  mmSKRIPTE0005770_Plg_5
  gRNA
gagcuuacuuggguacgugg

SEQ ID NO: 134992 - RNA, 20 nt, Artificial Sequence
  mmSKRIPTE0005771_Plg_6
  gRNA
aaggcggguauccucccgcu

SEQ ID NO: 134993 - RNA, 20 nt, Artificial Sequence
  mmSKRIPTE0005772_Plg_7
  gRNA
uugagaaauaggccugaacg

SEQ ID NO: 134994 - RNA, 20 nt, Artificial Sequence
  mmSKRIPTE0005773_Plg_8
  gRNA
gucaucuuauucgaaaagag

SEQ ID NO: 134995 - RNA, 20 nt, Artificial Sequence
  mmSKRIPTE0005774_Plg_9
  gRNA
cuacaccgguauauuauggg

SEQ ID NO: 134996 - RNA, 20 nt, Artificial Sequence
  mmSKRIPTE0005775_Nfkbil1_1
  gRNA
uugugauuaggucuccggag

SEQ ID NO: 134997 - RNA, 20 nt, Artificial Sequence
  mmSKRIPTE0005776_Nfkbil1_2
  gRNA
uccuacuuaagcugguggug

SEQ ID NO: 134998 - RNA, 20 nt, Artificial Sequence
  mmSKRIPTE0005777_Nfkbil1_3
  gRNA
gcacacgcgcaaguuucggg

SEQ ID NO: 134999 - RNA, 20 nt, Artificial Sequence
  mmSKRIPTE0005778_Nfkbil1_4
  gRNA
guggugacccauaacaaggu

SEQ ID NO: 135000 - RNA, 20 nt, Artificial Sequence
  mmSKRIPTE0005779_Nfkbil1_5
  gRNA
guucgguacgauuuccggga

SEQ ID NO: 135001 - RNA, 20 nt, Artificial Sequence
  mmSKRIPTE0005780_Nfkbil1_6
  gRNA
gugccaagggcaagaaaacg

SEQ ID NO: 135002 - RNA, 20 nt, Artificial Sequence
  mmSKRIPTE0005781_Nfkbil1_7
  gRNA
aauccaagauggcagccucg

SEQ ID NO: 135003 - RNA, 20 nt, Artificial Sequence
  mmSKRIPTE0005782_Nfkbil1_8
  gRNA
ucacaccauagccgccaugu

SEQ ID NO: 135004 - RNA, 20 nt, Artificial Sequence
  mmSKRIPTE0005783_Nfkbil1_9
  gRNA
uuguugacgucucucuaccg

SEQ ID NO: 135005 - RNA, 20 nt, Artificial Sequence
  mmSKRIPTE0005784_H2-T3_1
  gRNA
cgugcgcuucaacagcucag

SEQ ID NO: 135006 - RNA, 20 nt, Artificial Sequence
  mmSKRIPTE0005785_H2-T3_2
  gRNA
acugacgucacacgucacag

SEQ ID NO: 135007 - RNA, 20 nt, Artificial Sequence
  mmSKRIPTE0005786_H2-T3_3
  gRNA
gcauagucugcagauucucg

SEQ ID NO: 135008 - RNA, 20 nt, Artificial Sequence
  mmSKRIPTE0005787_H2-T3_4
  gRNA
gaccugcaaucagcgaaccg

SEQ ID NO: 135009 - RNA, 20 nt, Artificial Sequence
  mmSKRIPTE0005788_H2-T3_5
  gRNA
uagacacacugugccgugug

SEQ ID NO: 135010 - RNA, 20 nt, Artificial Sequence
  mmSKRIPTE0005789_H2-T3_6
  gRNA
cugguuauacagagcuccgu

SEQ ID NO: 135011 - RNA, 20 nt, Artificial Sequence
  mmSKRIPTE0005790_H2-T3_7
  gRNA
acagccauacaucaccugga

SEQ ID NO: 135012 - RNA, 20 nt, Artificial Sequence
  mmSKRIPTE0005791_H2-T3_8
  gRNA
gugccucagauucagcccga

SEQ ID NO: 135013 - RNA, 20 nt, Artificial Sequence
  mmSKRIPTE0005792_H2-T3_9
  gRNA
agccaugcugcucauaagcg

SEQ ID NO: 135014 - RNA, 20 nt, Artificial Sequence
  mmSKRIPTE0005793_Cd44_1
  gRNA
auauggcauuccuuauccca

SEQ ID NO: 135015 - RNA, 20 nt, Artificial Sequence
  mmSKRIPTE0005794_Cd44_2
  gRNA
auaagcgccgccccaaccag

SEQ ID NO: 135016 - RNA, 20 nt, Artificial Sequence
  mmSKRIPTE0005795_Cd44_3
  gRNA
cauggaauacaccugcguag

SEQ ID NO: 135017 - RNA, 20 nt, Artificial Sequence
  mmSKRIPTE0005796_Cd44_4
  gRNA
guucaugguacuaaugugcc

SEQ ID NO: 135018 - RNA, 20 nt, Artificial Sequence
  mmSKRIPTE0005797_Cd44_5
  gRNA
gcucauccauagauaccuag

SEQ ID NO: 135019 - RNA, 20 nt, Artificial Sequence
  mmSKRIPTE0005798_Cd44_6
  gRNA
uuauuucuguaacaggucgg

SEQ ID NO: 135020 - RNA, 20 nt, Artificial Sequence
  mmSKRIPTE0005799_Cd44_7
  gRNA
caccuuugugaaucauaggg

SEQ ID NO: 135021 - RNA, 20 nt, Artificial Sequence
  mmSKRIPTE0005800_Cd44_8
  gRNA
cccagggcgauucaacccag

SEQ ID NO: 135022 - RNA, 20 nt, Artificial Sequence
  mmSKRIPTE0005801_Cd44_9
  gRNA
cgaacccccggaaucugaug

SEQ ID NO: 135023 - RNA, 20 nt, Artificial Sequence
  mmSKRIPTE0005802_Il1b_1
  gRNA
ccacgguagacauauucuca

SEQ ID NO: 135024 - RNA, 20 nt, Artificial Sequence
  mmSKRIPTE0005803_Il1b_2
  gRNA
auuggucauagcccgcacug

SEQ ID NO: 135025 - RNA, 20 nt, Artificial Sequence
  mmSKRIPTE0005804_Il1b_3
  gRNA
uccagcguuagcuccccgag

SEQ ID NO: 135026 - RNA, 20 nt, Artificial Sequence
  mmSKRIPTE0005805_Il1b_4
  gRNA
aauuuaauuggccuacccag

SEQ ID NO: 135027 - RNA, 20 nt, Artificial Sequence
  mmSKRIPTE0005806_Il1b_5
  gRNA
cauauggguccgacagcacg

SEQ ID NO: 135028 - RNA, 20 nt, Artificial Sequence
  mmSKRIPTE0005807_Il1b_6
  gRNA
acacaagauauggacuagca

SEQ ID NO: 135029 - RNA, 20 nt, Artificial Sequence
  mmSKRIPTE0005808_Il1b_7
  gRNA
gcugagaaggaccagagcga

SEQ ID NO: 135030 - RNA, 20 nt, Artificial Sequence
  mmSKRIPTE0005809_Il1b_8
  gRNA
agcuaccugugucuuucccg

SEQ ID NO: 135031 - RNA, 20 nt, Artificial Sequence
  mmSKRIPTE0005810_Il1b_9
  gRNA
ugugccgucuuucauuacac

SEQ ID NO: 135032 - RNA, 20 nt, Artificial Sequence
  mmSKRIPTE0005811_Fcgr1_1
  gRNA
caaaugcccuuagaccacgc

SEQ ID NO: 135033 - RNA, 20 nt, Artificial Sequence
  mmSKRIPTE0005812_Fcgr1_2
  gRNA
ugggaugcuauaacuaggcg

SEQ ID NO: 135034 - RNA, 20 nt, Artificial Sequence
  mmSKRIPTE0005813_Fcgr1_3
  gRNA
uauugggaccuuuauaacca

SEQ ID NO: 135035 - RNA, 20 nt, Artificial Sequence
  mmSKRIPTE0005814_Fcgr1_4
  gRNA
acaccaaaagaagcgcccga

SEQ ID NO: 135036 - RNA, 20 nt, Artificial Sequence
  mmSKRIPTE0005815_Fcgr1_5
  gRNA
uccguugauaaaccauugug

SEQ ID NO: 135037 - RNA, 20 nt, Artificial Sequence
  mmSKRIPTE0005816_Fcgr1_6
  gRNA
ugaaaggagaccuauaccaa

SEQ ID NO: 135038 - RNA, 20 nt, Artificial Sequence
  mmSKRIPTE0005817_Fcgr1_7
  gRNA
cgucugcuccccugacacgc

SEQ ID NO: 135039 - RNA, 20 nt, Artificial Sequence
  mmSKRIPTE0005818_Fcgr1_8
  gRNA
agcagccaaucugaaaagug

SEQ ID NO: 135040 - RNA, 20 nt, Artificial Sequence
  mmSKRIPTE0005819_Fcgr1_9
  gRNA
ggaagcugaguccuacgacg

SEQ ID NO: 135041 - RNA, 20 nt, Artificial Sequence
  mmSKRIPTE0005820_Lmo4_1
  gRNA
aucaagagguucuuuacgcg

SEQ ID NO: 135042 - RNA, 20 nt, Artificial Sequence
  mmSKRIPTE0005821_Lmo4_2
  gRNA
gaguuugcguagcuccucga

SEQ ID NO: 135043 - RNA, 20 nt, Artificial Sequence
  mmSKRIPTE0005822_Lmo4_3
  gRNA
gaugaaaaaagauccaccga

SEQ ID NO: 135044 - RNA, 20 nt, Artificial Sequence
  mmSKRIPTE0005823_Lmo4_4
  gRNA
ugugcagauucgcugcagca

SEQ ID NO: 135045 - RNA, 20 nt, Artificial Sequence
  mmSKRIPTE0005824_Lmo4_5
  gRNA
cggguuccucgacuucgggg

SEQ ID NO: 135046 - RNA, 20 nt, Artificial Sequence
  mmSKRIPTE0005825_Lmo4_6
  gRNA
cuaaggacaacgagguagug

SEQ ID NO: 135047 - RNA, 20 nt, Artificial Sequence
  mmSKRIPTE0005826_Lmo4_7
  gRNA
aauuaacucuccaacgcaca

SEQ ID NO: 135048 - RNA, 20 nt, Artificial Sequence
  mmSKRIPTE0005827_Lmo4_8
  gRNA
gacgaauucucaaaacuccg

SEQ ID NO: 135049 - RNA, 20 nt, Artificial Sequence
  mmSKRIPTE0005828_Lmo4_9
  gRNA
gcaaccgggagauauacccc

SEQ ID NO: 135050 - RNA, 20 nt, Artificial Sequence
  mmSKRIPTE0005829_Crcp_1
  gRNA
cguuaguaacuggaacaccu

SEQ ID NO: 135051 - RNA, 20 nt, Artificial Sequence
  mmSKRIPTE0005830_Crcp_2
  gRNA
aauggaguaucgcugccacg

SEQ ID NO: 135052 - RNA, 20 nt, Artificial Sequence
  mmSKRIPTE0005831_Crcp_3
  gRNA
gcagccgagucaccuugcgu

SEQ ID NO: 135053 - RNA, 20 nt, Artificial Sequence
  mmSKRIPTE0005832_Crcp_4
  gRNA
caaaagcacuagcaaugacg

SEQ ID NO: 135054 - RNA, 20 nt, Artificial Sequence
  mmSKRIPTE0005833_Crcp_5
  gRNA
aaguguaagcgacacgacca

SEQ ID NO: 135055 - RNA, 20 nt, Artificial Sequence
  mmSKRIPTE0005834_Crcp_6
  gRNA
aucaucuggggaccgcgaag

SEQ ID NO: 135056 - RNA, 20 nt, Artificial Sequence
  mmSKRIPTE0005835_Crcp_7
  gRNA
gcuucacuuaaggcacgggu

SEQ ID NO: 135057 - RNA, 20 nt, Artificial Sequence
  mmSKRIPTE0005836_Crcp_8
  gRNA
ggaucccaagaccgugcacg

SEQ ID NO: 135058 - RNA, 20 nt, Artificial Sequence
  mmSKRIPTE0005837_Crcp_9
  gRNA
auccacaguaggaugacacc

SEQ ID NO: 135059 - RNA, 20 nt, Artificial Sequence
  mmSKRIPTE0005838_Clec4f_1
  gRNA
caauagaggccuguuaagug

SEQ ID NO: 135060 - RNA, 20 nt, Artificial Sequence
  mmSKRIPTE0005839_Clec4f_2
  gRNA
auuccacccaggucgaggag

SEQ ID NO: 135061 - RNA, 20 nt, Artificial Sequence
  mmSKRIPTE0005840_Clec4f_3
  gRNA
gcuaugacuucccagacccg

SEQ ID NO: 135062 - RNA, 20 nt, Artificial Sequence
  mmSKRIPTE0005841_Clec4f_4
  gRNA
aaugaccuggacgugccgca

SEQ ID NO: 135063 - RNA, 20 nt, Artificial Sequence
  mmSKRIPTE0005842_Clec4f_5
  gRNA
ggaaacuaucuuauacccag

SEQ ID NO: 135064 - RNA, 20 nt, Artificial Sequence
  mmSKRIPTE0005843_Clec4f_6
  gRNA
ccggcagcaguggaacgaca

SEQ ID NO: 135065 - RNA, 20 nt, Artificial Sequence
  mmSKRIPTE0005844_Clec4f_7
  gRNA
gacagugaguaguuccagug

SEQ ID NO: 135066 - RNA, 20 nt, Artificial Sequence
  mmSKRIPTE0005845_Clec4f_8
  gRNA
ggcagcauucuagggcaccu

SEQ ID NO: 135067 - RNA, 20 nt, Artificial Sequence
  mmSKRIPTE0005846_Clec4f_9
  gRNA
augggucagaauaaacaggu

SEQ ID NO: 135068 - RNA, 20 nt, Artificial Sequence
  mmSKRIPTE0005847_Bcl3_1
  gRNA
uccaaggaggcugauacggu

SEQ ID NO: 135069 - RNA, 20 nt, Artificial Sequence
  mmSKRIPTE0005848_Bcl3_2
  gRNA
uggcgcggacaucgaugcag

SEQ ID NO: 135070 - RNA, 20 nt, Artificial Sequence
  mmSKRIPTE0005849_Bcl3_3
  gRNA
ggcugugucaaaaaugacgu

SEQ ID NO: 135071 - RNA, 20 nt, Artificial Sequence
  mmSKRIPTE0005850_Bcl3_4
  gRNA
gcguuugcggaguggcagcg

SEQ ID NO: 135072 - RNA, 20 nt, Artificial Sequence
  mmSKRIPTE0005851_Bcl3_5
  gRNA
cgcucuugauauccugcgag

SEQ ID NO: 135073 - RNA, 20 nt, Artificial Sequence
  mmSKRIPTE0005852_Bcl3_6
  gRNA
uaaaggucgcaauggccuug

SEQ ID NO: 135074 - RNA, 20 nt, Artificial Sequence
  mmSKRIPTE0005853_Bcl3_7
  gRNA
ugaccggguagauccccgac

SEQ ID NO: 135075 - RNA, 20 nt, Artificial Sequence
  mmSKRIPTE0005854_Bcl3_8
  gRNA
uccugguagagcaagacaag

SEQ ID NO: 135076 - RNA, 20 nt, Artificial Sequence
  mmSKRIPTE0005855_Bcl3_9
  gRNA
uagacguccauaacaaccug

SEQ ID NO: 135077 - RNA, 20 nt, Artificial Sequence
  mmSKRIPTE0005856_Klf2_1
  gRNA
cuggccgcgaaaugaacccg

SEQ ID NO: 135078 - RNA, 20 nt, Artificial Sequence
  mmSKRIPTE0005857_Klf2_2
  gRNA
uuagccgcgguauauaagcc

SEQ ID NO: 135079 - RNA, 20 nt, Artificial Sequence
  mmSKRIPTE0005858_Klf2_3
  gRNA
cuagccucgauccucuagug

SEQ ID NO: 135080 - RNA, 20 nt, Artificial Sequence
  mmSKRIPTE0005859_Klf2_4
  gRNA
uguggcagguuccacgcgcg

SEQ ID NO: 135081 - RNA, 20 nt, Artificial Sequence
  mmSKRIPTE0005860_Klf2_5
  gRNA
gaggcccguagugcaacgcg

SEQ ID NO: 135082 - RNA, 20 nt, Artificial Sequence
  mmSKRIPTE0005861_Klf2_6
  gRNA
accuaaucucagaauguuag

SEQ ID NO: 135083 - RNA, 20 nt, Artificial Sequence
  mmSKRIPTE0005862_Klf2_7
  gRNA
agucuaugacacugccaagg

SEQ ID NO: 135084 - RNA, 20 nt, Artificial Sequence
  mmSKRIPTE0005863_Klf2_8
  gRNA
gcuucucaccugcaucagag

SEQ ID NO: 135085 - RNA, 20 nt, Artificial Sequence
  mmSKRIPTE0005864_Klf2_9
  gRNA
aguuuggcuaaaccccaaga

SEQ ID NO: 135086 - RNA, 20 nt, Artificial Sequence
  mmSKRIPTE0005865_Bcap31_1
  gRNA
agggaccaguauuaucacac

SEQ ID NO: 135087 - RNA, 20 nt, Artificial Sequence
  mmSKRIPTE0005866_Bcap31_2
  gRNA
ggcugacuuucggaccaacg

SEQ ID NO: 135088 - RNA, 20 nt, Artificial Sequence
  mmSKRIPTE0005867_Bcap31_3
  gRNA
gagaugagccacuagcacug

SEQ ID NO: 135089 - RNA, 20 nt, Artificial Sequence
  mmSKRIPTE0005868_Bcap31_4
  gRNA
gcucuucugcaguggcuacg

SEQ ID NO: 135090 - RNA, 20 nt, Artificial Sequence
  mmSKRIPTE0005869_Bcap31_5
  gRNA
acaaugggcggagccguuag

SEQ ID NO: 135091 - RNA, 20 nt, Artificial Sequence
  mmSKRIPTE0005870_Bcap31_6
  gRNA
aaguuaaagauugcccagga

SEQ ID NO: 135092 - RNA, 20 nt, Artificial Sequence
  mmSKRIPTE0005871_Bcap31_7
  gRNA
uguccgaagugucagaggcg

SEQ ID NO: 135093 - RNA, 20 nt, Artificial Sequence
  mmSKRIPTE0005872_Bcap31_8
  gRNA
ccugcccuaaacuccgaagu

SEQ ID NO: 135094 - RNA, 20 nt, Artificial Sequence
  mmSKRIPTE0005873_Bcap31_9
  gRNA
aaguaccagagggauagucu

SEQ ID NO: 135095 - RNA, 20 nt, Artificial Sequence
  mmSKRIPTE0005874_Ccl5_1
  gRNA
uguagaaauacuccuugacg

SEQ ID NO: 135096 - RNA, 20 nt, Artificial Sequence
  mmSKRIPTE0005875_Ccl5_2
  gRNA
cccugagaaggaucacggcg

SEQ ID NO: 135097 - RNA, 20 nt, Artificial Sequence
  mmSKRIPTE0005876_Ccl5_3
  gRNA
ugccucaccauguaagucga

SEQ ID NO: 135098 - RNA, 20 nt, Artificial Sequence
  mmSKRIPTE0005877_Ccl5_4
  gRNA
aaccuuugccuaauccucug

SEQ ID NO: 135099 - RNA, 20 nt, Artificial Sequence
  mmSKRIPTE0005878_Ccl5_5
  gRNA
ccugucuaugcuaacgacac

SEQ ID NO: 135100 - RNA, 20 nt, Artificial Sequence
  mmSKRIPTE0005879_Ccl5_6
  gRNA
augacaggguagccguguca

SEQ ID NO: 135101 - RNA, 20 nt, Artificial Sequence
  mmSKRIPTE0005880_Ccl5_7
  gRNA
ugcuuagacuucaacccuag

SEQ ID NO: 135102 - RNA, 20 nt, Artificial Sequence
  mmSKRIPTE0005881_Ccl5_8
  gRNA
ugggcaucucagcugcuccg

SEQ ID NO: 135103 - RNA, 20 nt, Artificial Sequence
  mmSKRIPTE0005882_Ccl5_9
  gRNA
auggcuucuauaccccacag

SEQ ID NO: 135104 - RNA, 20 nt, Artificial Sequence
  mmSKRIPTE0005883_Acvr1b_1
  gRNA
gaggaaauggauuagcacgg

SEQ ID NO: 135105 - RNA, 20 nt, Artificial Sequence
  mmSKRIPTE0005884_Acvr1b_2
  gRNA
ucuuagcuacgcaauaaccc

SEQ ID NO: 135106 - RNA, 20 nt, Artificial Sequence
  mmSKRIPTE0005885_Acvr1b_3
  gRNA
agccagacccugacguggag

SEQ ID NO: 135107 - RNA, 20 nt, Artificial Sequence
  mmSKRIPTE0005886_Acvr1b_4
  gRNA
agggaauggaaucaugcgau

SEQ ID NO: 135108 - RNA, 20 nt, Artificial Sequence
  mmSKRIPTE0005887_Acvr1b_5
  gRNA
cgguucggggaaguauggcg

SEQ ID NO: 135109 - RNA, 20 nt, Artificial Sequence
  mmSKRIPTE0005888_Acvr1b_6
  gRNA
aaaagccucaacgcaucacg

SEQ ID NO: 135110 - RNA, 20 nt, Artificial Sequence
  mmSKRIPTE0005889_Acvr1b_7
  gRNA
cuugugcuguugccucaccg

SEQ ID NO: 135111 - RNA, 20 nt, Artificial Sequence
  mmSKRIPTE0005890_Acvr1b_8
  gRNA
gccacacuucuauggaacca

SEQ ID NO: 135112 - RNA, 20 nt, Artificial Sequence
  mmSKRIPTE0005891_Acvr1b_9
  gRNA
gugucuaccauaaccgccag

SEQ ID NO: 135113 - RNA, 20 nt, Artificial Sequence
  mmSKRIPTE0005892_Pitx2_1
  gRNA
uucaagucucggcuaacacg

SEQ ID NO: 135114 - RNA, 20 nt, Artificial Sequence
  mmSKRIPTE0005893_Pitx2_2
  gRNA
agagcgcuaccgagaaccgg

SEQ ID NO: 135115 - RNA, 20 nt, Artificial Sequence
  mmSKRIPTE0005894_Pitx2_3
  gRNA
aagucgcccccuccuaggga

SEQ ID NO: 135116 - RNA, 20 nt, Artificial Sequence
  mmSKRIPTE0005895_Pitx2_4
  gRNA
cucgcgaagaaaucgccgug

SEQ ID NO: 135117 - RNA, 20 nt, Artificial Sequence
  mmSKRIPTE0005896_Pitx2_5
  gRNA
aaacccuccagaaacacgca

SEQ ID NO: 135118 - RNA, 20 nt, Artificial Sequence
  mmSKRIPTE0005897_Pitx2_6
  gRNA
aaaagaguucggcagccgaa

SEQ ID NO: 135119 - RNA, 20 nt, Artificial Sequence
  mmSKRIPTE0005898_Pitx2_7
  gRNA
gcaguauccugguuuaacgc

SEQ ID NO: 135120 - RNA, 20 nt, Artificial Sequence
  mmSKRIPTE0005899_Pitx2_8
  gRNA
uugcucgcuggucuuuaccg

SEQ ID NO: 135121 - RNA, 20 nt, Artificial Sequence
  mmSKRIPTE0005900_Pitx2_9
  gRNA
uuggaggaguccaaggagcg

SEQ ID NO: 135122 - RNA, 20 nt, Artificial Sequence
  mmSKRIPTE0005901_Rab34_1
  gRNA
gugucauuguaggauccgcg

SEQ ID NO: 135123 - RNA, 20 nt, Artificial Sequence
  mmSKRIPTE0005902_Rab34_2
  gRNA
acaacccuagacgcgcagcg

SEQ ID NO: 135124 - RNA, 20 nt, Artificial Sequence
  mmSKRIPTE0005903_Rab34_3
  gRNA
gggguaccgacaaucacccg

SEQ ID NO: 135125 - RNA, 20 nt, Artificial Sequence
  mmSKRIPTE0005904_Rab34_4
  gRNA
ggagacccgacgauuauccg

SEQ ID NO: 135126 - RNA, 20 nt, Artificial Sequence
  mmSKRIPTE0005905_Rab34_5
  gRNA
uugugggagaccuaucugug

SEQ ID NO: 135127 - RNA, 20 nt, Artificial Sequence
  mmSKRIPTE0005906_Rab34_6
  gRNA
gcgucccgaagaccacucgg

SEQ ID NO: 135128 - RNA, 20 nt, Artificial Sequence
  mmSKRIPTE0005907_Rab34_7
  gRNA
gaguugucgucgggucuccg

SEQ ID NO: 135129 - RNA, 20 nt, Artificial Sequence
  mmSKRIPTE0005908_Rab34_8
  gRNA
guguugcaacgcucgcagag

SEQ ID NO: 135130 - RNA, 20 nt, Artificial Sequence
  mmSKRIPTE0005909_Rab34_9
  gRNA
ugaacauucuggcgcccgug

SEQ ID NO: 135131 - RNA, 20 nt, Artificial Sequence
  mmSKRIPTE0005910_Wnt5a_1
  gRNA
ucucauaggaacccuuagcg

SEQ ID NO: 135132 - RNA, 20 nt, Artificial Sequence
  mmSKRIPTE0005911_Wnt5a_2
  gRNA
gcaaugaaggacgauacucc

SEQ ID NO: 135133 - RNA, 20 nt, Artificial Sequence
  mmSKRIPTE0005912_Wnt5a_3
  gRNA
uucgcagugcucaacuacau

SEQ ID NO: 135134 - RNA, 20 nt, Artificial Sequence
  mmSKRIPTE0005913_Wnt5a_4
  gRNA
ugagacacucccuaacccag

SEQ ID NO: 135135 - RNA, 20 nt, Artificial Sequence
  mmSKRIPTE0005914_Wnt5a_5
  gRNA
caaggagaaguaugauagcg

SEQ ID NO: 135136 - RNA, 20 nt, Artificial Sequence
  mmSKRIPTE0005915_Wnt5a_6
  gRNA
ugccugcgauuaaggaugag

SEQ ID NO: 135137 - RNA, 20 nt, Artificial Sequence
  mmSKRIPTE0005916_Wnt5a_7
  gRNA
agagacggccuucacguacg

SEQ ID NO: 135138 - RNA, 20 nt, Artificial Sequence
  mmSKRIPTE0005917_Wnt5a_8
  gRNA
caugagccgagcaugccggg

SEQ ID NO: 135139 - RNA, 20 nt, Artificial Sequence
  mmSKRIPTE0005918_Wnt5a_9
  gRNA
gcagggugaugcaaauaggu

SEQ ID NO: 135140 - RNA, 20 nt, Artificial Sequence
  mmSKRIPTE0005919_Cd86_1
  gRNA
gcuuuccuagagaguacgga

SEQ ID NO: 135141 - RNA, 20 nt, Artificial Sequence
  mmSKRIPTE0005920_Cd86_2
  gRNA
uuaacacuaacaccguaaca

SEQ ID NO: 135142 - RNA, 20 nt, Artificial Sequence
  mmSKRIPTE0005921_Cd86_3
  gRNA
acuuacggaagcacccacga

SEQ ID NO: 135143 - RNA, 20 nt, Artificial Sequence
  mmSKRIPTE0005922_Cd86_4
  gRNA
uguguggucccugagcgccg

SEQ ID NO: 135144 - RNA, 20 nt, Artificial Sequence
  mmSKRIPTE0005923_Cd86_5
  gRNA
ucugccgugcccauuuacaa

SEQ ID NO: 135145 - RNA, 20 nt, Artificial Sequence
  mmSKRIPTE0005924_Cd86_6
  gRNA
uuaagaaaaagucaaccacc

SEQ ID NO: 135146 - RNA, 20 nt, Artificial Sequence
  mmSKRIPTE0005925_Cd86_7
  gRNA
cauaguguaucuauacggca

SEQ ID NO: 135147 - RNA, 20 nt, Artificial Sequence
  mmSKRIPTE0005926_Cd86_8
  gRNA
ccggccagcuagcucuccga

SEQ ID NO: 135148 - RNA, 20 nt, Artificial Sequence
  mmSKRIPTE0005927_Cd86_9
  gRNA
caaacauaacuagaaucgua

SEQ ID NO: 135149 - RNA, 20 nt, Artificial Sequence
  mmSKRIPTE0005928_Zfp35_1
  gRNA
ggggcuguucgacuucacgc

SEQ ID NO: 135150 - RNA, 20 nt, Artificial Sequence
  mmSKRIPTE0005929_Zfp35_2
  gRNA
gggcugguggaauaacgaag

SEQ ID NO: 135151 - RNA, 20 nt, Artificial Sequence
  mmSKRIPTE0005930_Zfp35_3
  gRNA
agcuucccuaccgaucaccu

SEQ ID NO: 135152 - RNA, 20 nt, Artificial Sequence
  mmSKRIPTE0005931_Zfp35_4
  gRNA
gacucccagcuuuagcauag

SEQ ID NO: 135153 - RNA, 20 nt, Artificial Sequence
  mmSKRIPTE0005932_Zfp35_5
  gRNA
cagggcugagcucauccgaa

SEQ ID NO: 135154 - RNA, 20 nt, Artificial Sequence
  mmSKRIPTE0005933_Zfp35_6
  gRNA
aauucacagagcgcguacuu

SEQ ID NO: 135155 - RNA, 20 nt, Artificial Sequence
  mmSKRIPTE0005934_Zfp35_7
  gRNA
cagugcauuucagguuacgu

SEQ ID NO: 135156 - RNA, 20 nt, Artificial Sequence
  mmSKRIPTE0005935_Zfp35_8
  gRNA
ugcagacguuacaguaagag

SEQ ID NO: 135157 - RNA, 20 nt, Artificial Sequence
  mmSKRIPTE0005936_Zfp35_9
  gRNA
uguucuaaaagcuucagucg

SEQ ID NO: 135158 - RNA, 20 nt, Artificial Sequence
  mmSKRIPTE0005937_Il7_1
  gRNA
guguggccguacccacccug

SEQ ID NO: 135159 - RNA, 20 nt, Artificial Sequence
  mmSKRIPTE0005938_Il7_2
  gRNA
auucauuggugaaccacugg

SEQ ID NO: 135160 - RNA, 20 nt, Artificial Sequence
  mmSKRIPTE0005939_Il7_3
  gRNA
uugcccaucuccuagacuug

SEQ ID NO: 135161 - RNA, 20 nt, Artificial Sequence
  mmSKRIPTE0005940_Il7_4
  gRNA
agucaccccaggaaugucug

SEQ ID NO: 135162 - RNA, 20 nt, Artificial Sequence
  mmSKRIPTE0005941_Il7_5
  gRNA
auggcccagcauguuacaug

SEQ ID NO: 135163 - RNA, 20 nt, Artificial Sequence
  mmSKRIPTE0005942_Il7_6
  gRNA
augaaagggguauaguucau

SEQ ID NO: 135164 - RNA, 20 nt, Artificial Sequence
  mmSKRIPTE0005943_Il7_7
  gRNA
aggcaugacucgcuuuccaa

SEQ ID NO: 135165 - RNA, 20 nt, Artificial Sequence
  mmSKRIPTE0005944_Il7_8
  gRNA
augaacacucucgagaguaa

SEQ ID NO: 135166 - RNA, 20 nt, Artificial Sequence
  mmSKRIPTE0005945_Il7_9
  gRNA
acccagcaauuaaugagcag

SEQ ID NO: 135167 - RNA, 20 nt, Artificial Sequence
  mmSKRIPTE0005946_Dennd1b_1
  gRNA
auuaguugggcaugccaacg

SEQ ID NO: 135168 - RNA, 20 nt, Artificial Sequence
  mmSKRIPTE0005947_Dennd1b_2
  gRNA
auucccuccuaggcccugcg

SEQ ID NO: 135169 - RNA, 20 nt, Artificial Sequence
  mmSKRIPTE0005948_Dennd1b_3
  gRNA
acuucuuacaguuagcaacg

SEQ ID NO: 135170 - RNA, 20 nt, Artificial Sequence
  mmSKRIPTE0005949_Dennd1b_4
  gRNA
uugaauaagaacugucaacc

SEQ ID NO: 135171 - RNA, 20 nt, Artificial Sequence
  mmSKRIPTE0005950_Dennd1b_5
  gRNA
acuauggcuauuccuaggug

SEQ ID NO: 135172 - RNA, 20 nt, Artificial Sequence
  mmSKRIPTE0005951_Dennd1b_6
  gRNA
uugaguaggucuaaugagag

SEQ ID NO: 135173 - RNA, 20 nt, Artificial Sequence
  mmSKRIPTE0005952_Dennd1b_7
  gRNA
uguaaugugaggaagcguca

SEQ ID NO: 135174 - RNA, 20 nt, Artificial Sequence
  mmSKRIPTE0005953_Dennd1b_8
  gRNA
ucacucaccggaauuaguga

SEQ ID NO: 135175 - RNA, 20 nt, Artificial Sequence
  mmSKRIPTE0005954_Dennd1b_9
  gRNA
accuucguguaauggcucug

SEQ ID NO: 135176 - RNA, 20 nt, Artificial Sequence
  mmSKRIPTE0005955_Enpp1_1
  gRNA
auuguuuggaaacggucgag

SEQ ID NO: 135177 - RNA, 20 nt, Artificial Sequence
  mmSKRIPTE0005956_Enpp1_2
  gRNA
ggaagguguaagacgcccag

SEQ ID NO: 135178 - RNA, 20 nt, Artificial Sequence
  mmSKRIPTE0005957_Enpp1_3
  gRNA
cagacacuuucgcuaaugga

SEQ ID NO: 135179 - RNA, 20 nt, Artificial Sequence
  mmSKRIPTE0005958_Enpp1_4
  gRNA
uugcagcuauacucacccaa

SEQ ID NO: 135180 - RNA, 20 nt, Artificial Sequence
  mmSKRIPTE0005959_Enpp1_5
  gRNA
ucaaugagaaaccuucacga

SEQ ID NO: 135181 - RNA, 20 nt, Artificial Sequence
  mmSKRIPTE0005960_Enpp1_6
  gRNA
aagguggcgagguacuuacu

SEQ ID NO: 135182 - RNA, 20 nt, Artificial Sequence
  mmSKRIPTE0005961_Enpp1_7
  gRNA
cuucagcguugaguacugaa

SEQ ID NO: 135183 - RNA, 20 nt, Artificial Sequence
  mmSKRIPTE0005962_Enpp1_8
  gRNA
gcggcuguuauccgugagug

SEQ ID NO: 135184 - RNA, 20 nt, Artificial Sequence
  mmSKRIPTE0005963_Enpp1_9
  gRNA
auaugacuguacccuacggg

SEQ ID NO: 135185 - RNA, 20 nt, Artificial Sequence
  mmSKRIPTE0005964_Nr1h4_1
  gRNA
ugcaguaggagagcccacgu

SEQ ID NO: 135186 - RNA, 20 nt, Artificial Sequence
  mmSKRIPTE0005965_Nr1h4_2
  gRNA
cuagucuguauuuacaaccg

SEQ ID NO: 135187 - RNA, 20 nt, Artificial Sequence
  mmSKRIPTE0005966_Nr1h4_3
  gRNA
cugaaacaaacuaaugacga

SEQ ID NO: 135188 - RNA, 20 nt, Artificial Sequence
  mmSKRIPTE0005967_Nr1h4_4
  gRNA
ugugacaaagaagccgcgaa

SEQ ID NO: 135189 - RNA, 20 nt, Artificial Sequence
  mmSKRIPTE0005968_Nr1h4_5
  gRNA
uuugcucaaaggguccgcag

SEQ ID NO: 135190 - RNA, 20 nt, Artificial Sequence
  mmSKRIPTE0005969_Nr1h4_6
  gRNA
gcuccuucucaguugccgug

SEQ ID NO: 135191 - RNA, 20 nt, Artificial Sequence
  mmSKRIPTE0005970_Nr1h4_7
  gRNA
ccuacugucaguugaugcga

SEQ ID NO: 135192 - RNA, 20 nt, Artificial Sequence
  mmSKRIPTE0005971_Nr1h4_8
  gRNA
uaagacgaggaggaaaucug

SEQ ID NO: 135193 - RNA, 20 nt, Artificial Sequence
  mmSKRIPTE0005972_Nr1h4_9
  gRNA
cuaaugaggacgacagcgaa

SEQ ID NO: 135194 - RNA, 20 nt, Artificial Sequence
  mmSKRIPTE0005973_Pawr_1
  gRNA
cggcguggucaacauccccg

SEQ ID NO: 135195 - RNA, 20 nt, Artificial Sequence
  mmSKRIPTE0005974_Pawr_2
  gRNA
ccacuccuccaggaaguccg

SEQ ID NO: 135196 - RNA, 20 nt, Artificial Sequence
  mmSKRIPTE0005975_Pawr_3
  gRNA
uaacacucccugaggacacg

SEQ ID NO: 135197 - RNA, 20 nt, Artificial Sequence
  mmSKRIPTE0005976_Pawr_4
  gRNA
ucacuuugaacgcucaccug

SEQ ID NO: 135198 - RNA, 20 nt, Artificial Sequence
  mmSKRIPTE0005977_Pawr_5
  gRNA
ugccuggaacuguucucgac

SEQ ID NO: 135199 - RNA, 20 nt, Artificial Sequence
  mmSKRIPTE0005978_Pawr_6
  gRNA
cgggaagcgagaaugcgcug

SEQ ID NO: 135200 - RNA, 20 nt, Artificial Sequence
  mmSKRIPTE0005979_Pawr_7
  gRNA
ucaguaaggauuuagacggc

SEQ ID NO: 135201 - RNA, 20 nt, Artificial Sequence
  mmSKRIPTE0005980_Pawr_8
  gRNA
ggacaaaggugaaucucaca

SEQ ID NO: 135202 - RNA, 20 nt, Artificial Sequence
  mmSKRIPTE0005981_Pawr_9
  gRNA
auaccgaagacucuuacugg

SEQ ID NO: 135203 - RNA, 20 nt, Artificial Sequence
  mmSKRIPTE0005982_Ikzf1_1
  gRNA
gcugcuguguaggauaaggu

SEQ ID NO: 135204 - RNA, 20 nt, Artificial Sequence
  mmSKRIPTE0005983_Ikzf1_2
  gRNA
gaacauggaacacaugaucg

SEQ ID NO: 135205 - RNA, 20 nt, Artificial Sequence
  mmSKRIPTE0005984_Ikzf1_3
  gRNA
uccgugaugauuugacaacc

SEQ ID NO: 135206 - RNA, 20 nt, Artificial Sequence
  mmSKRIPTE0005985_Ikzf1_4
  gRNA
auuguggcaugcucuccggu

SEQ ID NO: 135207 - RNA, 20 nt, Artificial Sequence
  mmSKRIPTE0005986_Ikzf1_5
  gRNA
cagaacuccaagagugaucg

SEQ ID NO: 135208 - RNA, 20 nt, Artificial Sequence
  mmSKRIPTE0005987_Ikzf1_6
  gRNA
gagaugcaaagagaucccga

SEQ ID NO: 135209 - RNA, 20 nt, Artificial Sequence
  mmSKRIPTE0005988_Ikzf1_7
  gRNA
acucuaacagcaauucaacc

SEQ ID NO: 135210 - RNA, 20 nt, Artificial Sequence
  mmSKRIPTE0005989_Ikzf1_8
  gRNA
guuaugacauaaagcaccac

SEQ ID NO: 135211 - RNA, 20 nt, Artificial Sequence
  mmSKRIPTE0005990_Ikzf1_9
  gRNA
uguuaugugacugaccucag

SEQ ID NO: 135212 - RNA, 20 nt, Artificial Sequence
  mmSKRIPTE0005991_Traf3_1
  gRNA
cagcgagcgguuacuacaga

SEQ ID NO: 135213 - RNA, 20 nt, Artificial Sequence
  mmSKRIPTE0005992_Traf3_2
  gRNA
ccuuggugcucaccacccgg

SEQ ID NO: 135214 - RNA, 20 nt, Artificial Sequence
  mmSKRIPTE0005993_Traf3_3
  gRNA
guguagagcaccgugaagug

SEQ ID NO: 135215 - RNA, 20 nt, Artificial Sequence
  mmSKRIPTE0005994_Traf3_4
  gRNA
gcauagcaaaaggggcaccg

SEQ ID NO: 135216 - RNA, 20 nt, Artificial Sequence
  mmSKRIPTE0005995_Traf3_5
  gRNA
gaauggagccuauagcacac

SEQ ID NO: 135217 - RNA, 20 nt, Artificial Sequence
  mmSKRIPTE0005996_Traf3_6
  gRNA
auacccggguccccaaccgg

SEQ ID NO: 135218 - RNA, 20 nt, Artificial Sequence
  mmSKRIPTE0005997_Traf3_7
  gRNA
cacacacccuacaggcacgg

SEQ ID NO: 135219 - RNA, 20 nt, Artificial Sequence
  mmSKRIPTE0005998_Traf3_8
  gRNA
ucaaggcuccuuccuaugcg

SEQ ID NO: 135220 - RNA, 20 nt, Artificial Sequence
  mmSKRIPTE0005999_Traf3_9
  gRNA
ucuagacuccuuacagcgca

SEQ ID NO: 135221 - RNA, 20 nt, Artificial Sequence
  mmSKRIPTE0006000_Smad5_1
  gRNA
acacaaaguuuagcgcagcg

SEQ ID NO: 135222 - RNA, 20 nt, Artificial Sequence
  mmSKRIPTE0006001_Smad5_2
  gRNA
cuuuacaugauuagauacag

SEQ ID NO: 135223 - RNA, 20 nt, Artificial Sequence
  mmSKRIPTE0006002_Smad5_3
  gRNA
agaaaucccaaccuauucug

SEQ ID NO: 135224 - RNA, 20 nt, Artificial Sequence
  mmSKRIPTE0006003_Smad5_4
  gRNA
gaguccaaggcaacuuacgu

SEQ ID NO: 135225 - RNA, 20 nt, Artificial Sequence
  mmSKRIPTE0006004_Smad5_5
  gRNA
aacuugcagacguccaucca

SEQ ID NO: 135226 - RNA, 20 nt, Artificial Sequence
  mmSKRIPTE0006005_Smad5_6
  gRNA
agcaugcucugacccuaaga

SEQ ID NO: 135227 - RNA, 20 nt, Artificial Sequence
  mmSKRIPTE0006006_Smad5_7
  gRNA
ggauugaauucauugugacg

SEQ ID NO: 135228 - RNA, 20 nt, Artificial Sequence
  mmSKRIPTE0006007_Smad5_8
  gRNA
uaaugcucauaacauuguag

SEQ ID NO: 135229 - RNA, 20 nt, Artificial Sequence
  mmSKRIPTE0006008_Smad5_9
  gRNA
ucacucuccggacgucgcag

SEQ ID NO: 135230 - RNA, 20 nt, Artificial Sequence
  mmSKRIPTE0006009_Trim13_1
  gRNA
aguuucgagacuuggcgccg

SEQ ID NO: 135231 - RNA, 20 nt, Artificial Sequence
  mmSKRIPTE0006010_Trim13_2
  gRNA
agcccuccaguuacucacga

SEQ ID NO: 135232 - RNA, 20 nt, Artificial Sequence
  mmSKRIPTE0006011_Trim13_3
  gRNA
gugcuccgaguagggaccgg

SEQ ID NO: 135233 - RNA, 20 nt, Artificial Sequence
  mmSKRIPTE0006012_Trim13_4
  gRNA
ucucuggaagaggaacacgu

SEQ ID NO: 135234 - RNA, 20 nt, Artificial Sequence
  mmSKRIPTE0006013_Trim13_5
  gRNA
gcaauccaaacucggcgcgu

SEQ ID NO: 135235 - RNA, 20 nt, Artificial Sequence
  mmSKRIPTE0006014_Trim13_6
  gRNA
ggaaugugcggaauucccug

SEQ ID NO: 135236 - RNA, 20 nt, Artificial Sequence
  mmSKRIPTE0006015_Trim13_7
  gRNA
gcgccggugcaaaauggaca

SEQ ID NO: 135237 - RNA, 20 nt, Artificial Sequence
  mmSKRIPTE0006016_Trim13_8
  gRNA
uguaggucaaccuugacuag

SEQ ID NO: 135238 - RNA, 20 nt, Artificial Sequence
  mmSKRIPTE0006017_Trim13_9
  gRNA
aguccuaggaccauuccaga

SEQ ID NO: 135239 - RNA, 20 nt, Artificial Sequence
  mmSKRIPTE0006018_Adipoq_1
  gRNA
guaucgcucagcguucagug

SEQ ID NO: 135240 - RNA, 20 nt, Artificial Sequence
  mmSKRIPTE0006019_Adipoq_2
  gRNA
guaccaucuagucccacuca

SEQ ID NO: 135241 - RNA, 20 nt, Artificial Sequence
  mmSKRIPTE0006020_Adipoq_3
  gRNA
gacccaagcuggauuaaacc

SEQ ID NO: 135242 - RNA, 20 nt, Artificial Sequence
  mmSKRIPTE0006021_Adipoq_4
  gRNA
acgucaucuucggcaugacu

SEQ ID NO: 135243 - RNA, 20 nt, Artificial Sequence
  mmSKRIPTE0006022_Adipoq_5
  gRNA
uacauugggaacagugacgc

SEQ ID NO: 135244 - RNA, 20 nt, Artificial Sequence
  mmSKRIPTE0006023_Adipoq_6
  gRNA
aguaccagacuaaugagacc

SEQ ID NO: 135245 - RNA, 20 nt, Artificial Sequence
  mmSKRIPTE0006024_Adipoq_7
  gRNA
uugcuaccauguaagagucg

SEQ ID NO: 135246 - RNA, 20 nt, Artificial Sequence
  mmSKRIPTE0006025_Adipoq_8
  gRNA
cuuucauguacaccgugaug

SEQ ID NO: 135247 - RNA, 20 nt, Artificial Sequence
  mmSKRIPTE0006026_Adipoq_9
  gRNA
uagaagaguccugaauuugg

SEQ ID NO: 135248 - RNA, 20 nt, Artificial Sequence
  mmSKRIPTE0006027_Dlg1_1
  gRNA
caacugagacuagaccguag

SEQ ID NO: 135249 - RNA, 20 nt, Artificial Sequence
  mmSKRIPTE0006028_Dlg1_2
  gRNA
gacaucaauguauaacgcca

SEQ ID NO: 135250 - RNA, 20 nt, Artificial Sequence
  mmSKRIPTE0006029_Dlg1_3
  gRNA
guugcgcaauaucgacccga

SEQ ID NO: 135251 - RNA, 20 nt, Artificial Sequence
  mmSKRIPTE0006030_Dlg1_4
  gRNA
caggagaucccugacgacau

SEQ ID NO: 135252 - RNA, 20 nt, Artificial Sequence
  mmSKRIPTE0006031_Dlg1_5
  gRNA
gugaucagcgcacuaaacaa

SEQ ID NO: 135253 - RNA, 20 nt, Artificial Sequence
  mmSKRIPTE0006032_Dlg1_6
  gRNA
caguggcuguauuccuacca

SEQ ID NO: 135254 - RNA, 20 nt, Artificial Sequence
  mmSKRIPTE0006033_Dlg1_7
  gRNA
cuugaagucaguguguuccg

SEQ ID NO: 135255 - RNA, 20 nt, Artificial Sequence
  mmSKRIPTE0006034_Dlg1_8
  gRNA
caaaauuaucacaggcggag

SEQ ID NO: 135256 - RNA, 20 nt, Artificial Sequence
  mmSKRIPTE0006035_Dlg1_9
  gRNA
ucagugucccugcauacggu

SEQ ID NO: 135257 - RNA, 20 nt, Artificial Sequence
  mmSKRIPTE0006036_C8g_1
  gRNA
gucugugaaacuauacggug

SEQ ID NO: 135258 - RNA, 20 nt, Artificial Sequence
  mmSKRIPTE0006037_C8g_2
  gRNA
uacacauccugaacggugag

SEQ ID NO: 135259 - RNA, 20 nt, Artificial Sequence
  mmSKRIPTE0006038_C8g_3
  gRNA
gcagucucgcagaaaccuag

SEQ ID NO: 135260 - RNA, 20 nt, Artificial Sequence
  mmSKRIPTE0006039_C8g_4
  gRNA
cuggcagugagcggacugug

SEQ ID NO: 135261 - RNA, 20 nt, Artificial Sequence
  mmSKRIPTE0006040_C8g_5
  gRNA
ugggacucacagcuuucgga

SEQ ID NO: 135262 - RNA, 20 nt, Artificial Sequence
  mmSKRIPTE0006041_C8g_6
  gRNA
accuacuguccguagcaggu

SEQ ID NO: 135263 - RNA, 20 nt, Artificial Sequence
  mmSKRIPTE0006042_C8g_7
  gRNA
uccacuagauggccuuaucg

SEQ ID NO: 135264 - RNA, 20 nt, Artificial Sequence
  mmSKRIPTE0006043_C8g_8
  gRNA
cuggggagcugcgugcaaug

SEQ ID NO: 135265 - RNA, 20 nt, Artificial Sequence
  mmSKRIPTE0006044_C8g_9
  gRNA
ucccuguuccagguacagga

SEQ ID NO: 135266 - RNA, 20 nt, Artificial Sequence
  mmSKRIPTE0006045_Cd2_1
  gRNA
uaaaacaacaccuagaggug

SEQ ID NO: 135267 - RNA, 20 nt, Artificial Sequence
  mmSKRIPTE0006046_Cd2_2
  gRNA
ggcaaagguaagcauucgcg

SEQ ID NO: 135268 - RNA, 20 nt, Artificial Sequence
  mmSKRIPTE0006047_Cd2_3
  gRNA
gagccgggauuauggaacca

SEQ ID NO: 135269 - RNA, 20 nt, Artificial Sequence
  mmSKRIPTE0006048_Cd2_4
  gRNA
aaugacugaugauauugaug

SEQ ID NO: 135270 - RNA, 20 nt, Artificial Sequence
  mmSKRIPTE0006049_Cd2_5
  gRNA
ccgaugaugagaaacgacag

SEQ ID NO: 135271 - RNA, 20 nt, Artificial Sequence
  mmSKRIPTE0006050_Cd2_6
  gRNA
gccucuucuuagaucugucg

SEQ ID NO: 135272 - RNA, 20 nt, Artificial Sequence
  mmSKRIPTE0006051_Cd2_7
  gRNA
aaagcccggccauuguacau

SEQ ID NO: 135273 - RNA, 20 nt, Artificial Sequence
  mmSKRIPTE0006052_Cd2_8
  gRNA
acccacuccuuuaucgcugu

SEQ ID NO: 135274 - RNA, 20 nt, Artificial Sequence
  mmSKRIPTE0006053_Cd2_9
  gRNA
cugaggucucgggacuacgg

SEQ ID NO: 135275 - RNA, 20 nt, Artificial Sequence
  mmSKRIPTE0006054_Cdkn2b_1
  gRNA
uggaacuuaccguggccggu

SEQ ID NO: 135276 - RNA, 20 nt, Artificial Sequence
  mmSKRIPTE0006055_Cdkn2b_2
  gRNA
gauaccucgcaaugucacgg

SEQ ID NO: 135277 - RNA, 20 nt, Artificial Sequence
  mmSKRIPTE0006056_Cdkn2b_3
  gRNA
guuacaacucacagccgcgg

SEQ ID NO: 135278 - RNA, 20 nt, Artificial Sequence
  mmSKRIPTE0006057_Cdkn2b_4
  gRNA
cgucaugagacaaauaggcg

SEQ ID NO: 135279 - RNA, 20 nt, Artificial Sequence
  mmSKRIPTE0006058_Cdkn2b_5
  gRNA
agucgucugugccggcggug

SEQ ID NO: 135280 - RNA, 20 nt, Artificial Sequence
  mmSKRIPTE0006059_Cdkn2b_6
  gRNA
gcccaucaucaugaccugag

SEQ ID NO: 135281 - RNA, 20 nt, Artificial Sequence
  mmSKRIPTE0006060_Cdkn2b_7
  gRNA
cuggaugugugugacgccug

SEQ ID NO: 135282 - RNA, 20 nt, Artificial Sequence
  mmSKRIPTE0006061_Cdkn2b_8
  gRNA
uccagcugcagaaaaugcgu

SEQ ID NO: 135283 - RNA, 20 nt, Artificial Sequence
  mmSKRIPTE0006062_Cdkn2b_9
  gRNA
cgcaguuggguucugcuccg

SEQ ID NO: 135284 - RNA, 20 nt, Artificial Sequence
  mmSKRIPTE0006063_Oasl1_1
  gRNA
agcgugaacuagggaucacg

SEQ ID NO: 135285 - RNA, 20 nt, Artificial Sequence
  mmSKRIPTE0006064_Oasl1_2
  gRNA
uccuguccaagacgacggag

SEQ ID NO: 135286 - RNA, 20 nt, Artificial Sequence
  mmSKRIPTE0006065_Oasl1_3
  gRNA
gaucagauuugcguagaccu

SEQ ID NO: 135287 - RNA, 20 nt, Artificial Sequence
  mmSKRIPTE0006066_Oasl1_4
  gRNA
aaugccuacuuaguccacgc

SEQ ID NO: 135288 - RNA, 20 nt, Artificial Sequence
  mmSKRIPTE0006067_Oasl1_5
  gRNA
acagacaucagguuucccga

SEQ ID NO: 135289 - RNA, 20 nt, Artificial Sequence
  mmSKRIPTE0006068_Oasl1_6
  gRNA
ugugucugcacccgugacgu

SEQ ID NO: 135290 - RNA, 20 nt, Artificial Sequence
  mmSKRIPTE0006069_Oasl1_7
  gRNA
gcggguggaucgcauaggcg

SEQ ID NO: 135291 - RNA, 20 nt, Artificial Sequence
  mmSKRIPTE0006070_Oasl1_8
  gRNA
cugacacagucuugacagug

SEQ ID NO: 135292 - RNA, 20 nt, Artificial Sequence
  mmSKRIPTE0006071_Oasl1_9
  gRNA
ugucaugguaggugugccga

SEQ ID NO: 135293 - RNA, 20 nt, Artificial Sequence
  mmSKRIPTE0006072_Sh2b2_1
  gRNA
cgucgcguccauuugucacg

SEQ ID NO: 135294 - RNA, 20 nt, Artificial Sequence
  mmSKRIPTE0006073_Sh2b2_2
  gRNA
cuucaugguggcagacgacg

SEQ ID NO: 135295 - RNA, 20 nt, Artificial Sequence
  mmSKRIPTE0006074_Sh2b2_3
  gRNA
caccgcugucgucgucucgg

SEQ ID NO: 135296 - RNA, 20 nt, Artificial Sequence
  mmSKRIPTE0006075_Sh2b2_4
  gRNA
ccgucaaagggggaauacag

SEQ ID NO: 135297 - RNA, 20 nt, Artificial Sequence
  mmSKRIPTE0006076_Sh2b2_5
  gRNA
uggccgagcucgugacaccg

SEQ ID NO: 135298 - RNA, 20 nt, Artificial Sequence
  mmSKRIPTE0006077_Sh2b2_6
  gRNA
cggucuuggcgguccuggug

SEQ ID NO: 135299 - RNA, 20 nt, Artificial Sequence
  mmSKRIPTE0006078_Sh2b2_7
  gRNA
ggccuccagaacacucaccc

SEQ ID NO: 135300 - RNA, 20 nt, Artificial Sequence
  mmSKRIPTE0006079_Sh2b2_8
  gRNA
ccggguagaguaaaggaccg

SEQ ID NO: 135301 - RNA, 20 nt, Artificial Sequence
  mmSKRIPTE0006080_Sh2b2_9
  gRNA
guggcuugaucuaauugaca

SEQ ID NO: 135302 - RNA, 20 nt, Artificial Sequence
  mmSKRIPTE0006081_Flt1_1
  gRNA
aacaauaccucagcaccggu

SEQ ID NO: 135303 - RNA, 20 nt, Artificial Sequence
  mmSKRIPTE0006082_Flt1_2
  gRNA
aaacccgucuaauaucauag

SEQ ID NO: 135304 - RNA, 20 nt, Artificial Sequence
  mmSKRIPTE0006083_Flt1_3
  gRNA
aucgcgucuaacgcggacag

SEQ ID NO: 135305 - RNA, 20 nt, Artificial Sequence
  mmSKRIPTE0006084_Flt1_4
  gRNA
cccaugacauccgaccuacg

SEQ ID NO: 135306 - RNA, 20 nt, Artificial Sequence
  mmSKRIPTE0006085_Flt1_5
  gRNA
cacguaagacgcuguagccg

SEQ ID NO: 135307 - RNA, 20 nt, Artificial Sequence
  mmSKRIPTE0006086_Flt1_6
  gRNA
aggguacugccguuccugug

SEQ ID NO: 135308 - RNA, 20 nt, Artificial Sequence
  mmSKRIPTE0006087_Flt1_7
  gRNA
gagcaucucucagcgcauga

SEQ ID NO: 135309 - RNA, 20 nt, Artificial Sequence
  mmSKRIPTE0006088_Flt1_8
  gRNA
gacguguauacauucuagug

SEQ ID NO: 135310 - RNA, 20 nt, Artificial Sequence
  mmSKRIPTE0006089_Flt1_9
  gRNA
ccaccacggagcucaauacg

SEQ ID NO: 135311 - RNA, 20 nt, Artificial Sequence
  mmSKRIPTE0006090_Rps3_1
  gRNA
cguagagcccuucgaugaag

SEQ ID NO: 135312 - RNA, 20 nt, Artificial Sequence
  mmSKRIPTE0006091_Rps3_2
  gRNA
aguuguaccucggauaggag

SEQ ID NO: 135313 - RNA, 20 nt, Artificial Sequence
  mmSKRIPTE0006092_Rps3_3
  gRNA
uggaguaaaugaaggcacgc

SEQ ID NO: 135314 - RNA, 20 nt, Artificial Sequence
  mmSKRIPTE0006093_Rps3_4
  gRNA
ggcacuuguagaacccgcgg

SEQ ID NO: 135315 - RNA, 20 nt, Artificial Sequence
  mmSKRIPTE0006094_Rps3_5
  gRNA
cacgucaugugcaugcugca

SEQ ID NO: 135316 - RNA, 20 nt, Artificial Sequence
  mmSKRIPTE0006095_Rps3_6
  gRNA
cuaccccccaaucuucgcac

SEQ ID NO: 135317 - RNA, 20 nt, Artificial Sequence
  mmSKRIPTE0006096_Rps3_7
  gRNA
uugcgucuaaaacggcguag

SEQ ID NO: 135318 - RNA, 20 nt, Artificial Sequence
  mmSKRIPTE0006097_Rps3_8
  gRNA
agcacaccuagaagacgcca

SEQ ID NO: 135319 - RNA, 20 nt, Artificial Sequence
  mmSKRIPTE0006098_Rps3_9
  gRNA
cagggaccaagagcaagacg

SEQ ID NO: 135320 - RNA, 20 nt, Artificial Sequence
  mmSKRIPTE0006099_Kars_1
  gRNA
ccccaggaggaucaacugcg

SEQ ID NO: 135321 - RNA, 20 nt, Artificial Sequence
  mmSKRIPTE0006100_Kars_2
  gRNA
acccuuccgaagaaucagca

SEQ ID NO: 135322 - RNA, 20 nt, Artificial Sequence
  mmSKRIPTE0006101_Kars_3
  gRNA
aagagguuccacuuuacggg

SEQ ID NO: 135323 - RNA, 20 nt, Artificial Sequence
  mmSKRIPTE0006102_Kars_4
  gRNA
cuuaacgugagucuaggccu

SEQ ID NO: 135324 - RNA, 20 nt, Artificial Sequence
  mmSKRIPTE0006103_Kars_5
  gRNA
acagagacguguagucagag

SEQ ID NO: 135325 - RNA, 20 nt, Artificial Sequence
  mmSKRIPTE0006104_Kars_6
  gRNA
ccagauggacggcgccacac

SEQ ID NO: 135326 - RNA, 20 nt, Artificial Sequence
  mmSKRIPTE0006105_Kars_7
  gRNA
uguggcuauugacuaccuug

SEQ ID NO: 135327 - RNA, 20 nt, Artificial Sequence
  mmSKRIPTE0006106_Kars_8
  gRNA
uaggccgcauccacgccaag

SEQ ID NO: 135328 - RNA, 20 nt, Artificial Sequence
  mmSKRIPTE0006107_Kars_9
  gRNA
gaagagcagagcaucugccg

SEQ ID NO: 135329 - RNA, 20 nt, Artificial Sequence
  mmSKRIPTE0006108_Nedd4_1
  gRNA
acguugacacacacggccag

SEQ ID NO: 135330 - RNA, 20 nt, Artificial Sequence
  mmSKRIPTE0006109_Nedd4_2
  gRNA
ugauacaaccaacuggugug

SEQ ID NO: 135331 - RNA, 20 nt, Artificial Sequence
  mmSKRIPTE0006110_Nedd4_3
  gRNA
acaccccgugaaguuaugug

SEQ ID NO: 135332 - RNA, 20 nt, Artificial Sequence
  mmSKRIPTE0006111_Nedd4_4
  gRNA
guacggccacuccaugccaa

SEQ ID NO: 135333 - RNA, 20 nt, Artificial Sequence
  mmSKRIPTE0006112_Nedd4_5
  gRNA
cgguguugaaaaagcucgug

SEQ ID NO: 135334 - RNA, 20 nt, Artificial Sequence
  mmSKRIPTE0006113_Nedd4_6
  gRNA
ugaugcgguuggcaagcaag

SEQ ID NO: 135335 - RNA, 20 nt, Artificial Sequence
  mmSKRIPTE0006114_Nedd4_7
  gRNA
gcaucacauaagacgacaua

SEQ ID NO: 135336 - RNA, 20 nt, Artificial Sequence
  mmSKRIPTE0006115_Nedd4_8
  gRNA
gugguggcugcacaucagag

SEQ ID NO: 135337 - RNA, 20 nt, Artificial Sequence
  mmSKRIPTE0006116_Nedd4_9
  gRNA
ugauucgaguaggcguauag

SEQ ID NO: 135338 - RNA, 20 nt, Artificial Sequence
  mmSKRIPTE0006117_Hyal2_1
  gRNA
acgcgucccacauacacccg

SEQ ID NO: 135339 - RNA, 20 nt, Artificial Sequence
  mmSKRIPTE0006118_Hyal2_2
  gRNA
aaaguugcggcuguguacgg

SEQ ID NO: 135340 - RNA, 20 nt, Artificial Sequence
  mmSKRIPTE0006119_Hyal2_3
  gRNA
gucccggcugcaucaaaacg

SEQ ID NO: 135341 - RNA, 20 nt, Artificial Sequence
  mmSKRIPTE0006120_Hyal2_4
  gRNA
ugucucguccagguacacag

SEQ ID NO: 135342 - RNA, 20 nt, Artificial Sequence
  mmSKRIPTE0006121_Hyal2_5
  gRNA
guucaacaugaacugccgag

SEQ ID NO: 135343 - RNA, 20 nt, Artificial Sequence
  mmSKRIPTE0006122_Hyal2_6
  gRNA
ccugucccuagugagaagcg

SEQ ID NO: 135344 - RNA, 20 nt, Artificial Sequence
  mmSKRIPTE0006123_Hyal2_7
  gRNA
aagcaugcaguggcucccgg

SEQ ID NO: 135345 - RNA, 20 nt, Artificial Sequence
  mmSKRIPTE0006124_Hyal2_8
  gRNA
ggaacgcuacauccagaccc

SEQ ID NO: 135346 - RNA, 20 nt, Artificial Sequence
  mmSKRIPTE0006125_Hyal2_9
  gRNA
uaucaccacaguuuccgucg

SEQ ID NO: 135347 - RNA, 20 nt, Artificial Sequence
  mmSKRIPTE0006126_Eda_1
  gRNA
uuacuucggacaaccaguag

SEQ ID NO: 135348 - RNA, 20 nt, Artificial Sequence
  mmSKRIPTE0006127_Eda_2
  gRNA
auauggugcaggccaccuag

SEQ ID NO: 135349 - RNA, 20 nt, Artificial Sequence
  mmSKRIPTE0006128_Eda_3
  gRNA
uuaacuaguaguacauucag

SEQ ID NO: 135350 - RNA, 20 nt, Artificial Sequence
  mmSKRIPTE0006129_Eda_4
  gRNA
gacuagaacaaaauacacga

SEQ ID NO: 135351 - RNA, 20 nt, Artificial Sequence
  mmSKRIPTE0006130_Eda_5
  gRNA
guggccgauuucacacuggg

SEQ ID NO: 135352 - RNA, 20 nt, Artificial Sequence
  mmSKRIPTE0006131_Eda_6
  gRNA
augcuaccccuuuggcacag

SEQ ID NO: 135353 - RNA, 20 nt, Artificial Sequence
  mmSKRIPTE0006132_Eda_7
  gRNA
cuagaaaugaaguccccaug

SEQ ID NO: 135354 - RNA, 20 nt, Artificial Sequence
  mmSKRIPTE0006133_Eda_8
  gRNA
uccgaauugcggcgggaacg

SEQ ID NO: 135355 - RNA, 20 nt, Artificial Sequence
  mmSKRIPTE0006134_Eda_9
  gRNA
ucugagagcauuucgucaag

SEQ ID NO: 135356 - RNA, 20 nt, Artificial Sequence
  mmSKRIPTE0006135_Tsc22d3_1
  gRNA
guguacuguguuacgugcag

SEQ ID NO: 135357 - RNA, 20 nt, Artificial Sequence
  mmSKRIPTE0006136_Tsc22d3_2
  gRNA
agggagccccauaaaccgcg

SEQ ID NO: 135358 - RNA, 20 nt, Artificial Sequence
  mmSKRIPTE0006137_Tsc22d3_3
  gRNA
caggcaaaccuaccgaacuc

SEQ ID NO: 135359 - RNA, 20 nt, Artificial Sequence
  mmSKRIPTE0006138_Tsc22d3_4
  gRNA
ucccaggaugcuacaccgcg

SEQ ID NO: 135360 - RNA, 20 nt, Artificial Sequence
  mmSKRIPTE0006139_Tsc22d3_5
  gRNA
uucaccacgcagcagccgca

SEQ ID NO: 135361 - RNA, 20 nt, Artificial Sequence
  mmSKRIPTE0006140_Tsc22d3_6
  gRNA
cccuaguccagguucugcag

SEQ ID NO: 135362 - RNA, 20 nt, Artificial Sequence
  mmSKRIPTE0006141_Tsc22d3_7
  gRNA
acaggauuugugccauacca

SEQ ID NO: 135363 - RNA, 20 nt, Artificial Sequence
  mmSKRIPTE0006142_Tsc22d3_8
  gRNA
uagucaucacagcccguccg

SEQ ID NO: 135364 - RNA, 20 nt, Artificial Sequence
  mmSKRIPTE0006143_Tsc22d3_9
  gRNA
acaucaggugguucuucacg

SEQ ID NO: 135365 - RNA, 20 nt, Artificial Sequence
  mmSKRIPTE0006144_Dyrk3_1
  gRNA
augucuuaaugcuugagccg

SEQ ID NO: 135366 - RNA, 20 nt, Artificial Sequence
  mmSKRIPTE0006145_Dyrk3_2
  gRNA
uaucuacccagacggacggg

SEQ ID NO: 135367 - RNA, 20 nt, Artificial Sequence
  mmSKRIPTE0006146_Dyrk3_3
  gRNA
accacugagccacucacgag

SEQ ID NO: 135368 - RNA, 20 nt, Artificial Sequence
  mmSKRIPTE0006147_Dyrk3_4
  gRNA
ucgaacucacguauuacccu

SEQ ID NO: 135369 - RNA, 20 nt, Artificial Sequence
  mmSKRIPTE0006148_Dyrk3_5
  gRNA
ccgaaugccaaaaagcggca

SEQ ID NO: 135370 - RNA, 20 nt, Artificial Sequence
  mmSKRIPTE0006149_Dyrk3_6
  gRNA
cagcaccuuagacggccugg

SEQ ID NO: 135371 - RNA, 20 nt, Artificial Sequence
  mmSKRIPTE0006150_Dyrk3_7
  gRNA
ucacgcagggguaaaaagcg

SEQ ID NO: 135372 - RNA, 20 nt, Artificial Sequence
  mmSKRIPTE0006151_Dyrk3_8
  gRNA
uuacuggcuaucccaacgac

SEQ ID NO: 135373 - RNA, 20 nt, Artificial Sequence
  mmSKRIPTE0006152_Dyrk3_9
  gRNA
gcuggcuucgcuacaagacg

SEQ ID NO: 135374 - RNA, 20 nt, Artificial Sequence
  mmSKRIPTE0006153_Osm_1
  gRNA
cagccacuuuaugcccgacg

SEQ ID NO: 135375 - RNA, 20 nt, Artificial Sequence
  mmSKRIPTE0006154_Osm_2
  gRNA
cuguggugcaaacgguugug

SEQ ID NO: 135376 - RNA, 20 nt, Artificial Sequence
  mmSKRIPTE0006155_Osm_3
  gRNA
aguguccccuacuaccacuc

SEQ ID NO: 135377 - RNA, 20 nt, Artificial Sequence
  mmSKRIPTE0006156_Osm_4
  gRNA
gaaaggaccaacagcccgag

SEQ ID NO: 135378 - RNA, 20 nt, Artificial Sequence
  mmSKRIPTE0006157_Osm_5
  gRNA
uuaaaacacaagcucuagcg

SEQ ID NO: 135379 - RNA, 20 nt, Artificial Sequence
  mmSKRIPTE0006158_Osm_6
  gRNA
ggaaaaccuccggccccacg

SEQ ID NO: 135380 - RNA, 20 nt, Artificial Sequence
  mmSKRIPTE0006159_Osm_7
  gRNA
acacaagcugauucaccaca

SEQ ID NO: 135381 - RNA, 20 nt, Artificial Sequence
  mmSKRIPTE0006160_Osm_8
  gRNA
uaagggcugaggcuuacaua

SEQ ID NO: 135382 - RNA, 20 nt, Artificial Sequence
  mmSKRIPTE0006161_Osm_9
  gRNA
auacaggaugucgcucucag

SEQ ID NO: 135383 - RNA, 20 nt, Artificial Sequence
  mmSKRIPTE0006162_Acur2_1
  gRNA
ccaaugagagcuguccggcg

SEQ ID NO: 135384 - RNA, 20 nt, Artificial Sequence
  mmSKRIPTE0006163_Acur2_2
  gRNA
cuaccuacuagguuacacuc

SEQ ID NO: 135385 - RNA, 20 nt, Artificial Sequence
  mmSKRIPTE0006164_Acur2_3
  gRNA
ggugugcgacaacggcacug

SEQ ID NO: 135386 - RNA, 20 nt, Artificial Sequence
  mmSKRIPTE0006165_Acur2_4
  gRNA
guuacuaggagacacuucag

SEQ ID NO: 135387 - RNA, 20 nt, Artificial Sequence
  mmSKRIPTE0006166_Acur2_5
  gRNA
auauagcgagacucucagga

SEQ ID NO: 135388 - RNA, 20 nt, Artificial Sequence
  mmSKRIPTE0006167_Acur2_6
  gRNA
uaaaugcaggcucccacaag

SEQ ID NO: 135389 - RNA, 20 nt, Artificial Sequence
  mmSKRIPTE0006168_Acur2_7
  gRNA
aauacauuauggguguaaag

SEQ ID NO: 135390 - RNA, 20 nt, Artificial Sequence
  mmSKRIPTE0006169_Acur2_8
  gRNA
agccaccagaacaaaccugg

SEQ ID NO: 135391 - RNA, 20 nt, Artificial Sequence
  mmSKRIPTE0006170_Acur2_9
  gRNA
ccaaccaaaauagcuugaca

SEQ ID NO: 135392 - RNA, 20 nt, Artificial Sequence
  mmSKRIPTE0006171_Mink1_1
  gRNA
ggggcaacuccauuaccuag

SEQ ID NO: 135393 - RNA, 20 nt, Artificial Sequence
  mmSKRIPTE0006172_Mink1_2
  gRNA
cccacacuacugucugaccg

SEQ ID NO: 135394 - RNA, 20 nt, Artificial Sequence
  mmSKRIPTE0006173_Mink1_3
  gRNA
acucacacgcuggaccacca

SEQ ID NO: 135395 - RNA, 20 nt, Artificial Sequence
  mmSKRIPTE0006174_Mink1_4
  gRNA
ucgccgcuucucccccaucg

SEQ ID NO: 135396 - RNA, 20 nt, Artificial Sequence
  mmSKRIPTE0006175_Mink1_5
  gRNA
gacaaaagcaguacuuacgg

SEQ ID NO: 135397 - RNA, 20 nt, Artificial Sequence
  mmSKRIPTE0006176_Mink1_6
  gRNA
cuuagaaugcaccuuccgug

SEQ ID NO: 135398 - RNA, 20 nt, Artificial Sequence
  mmSKRIPTE0006177_Mink1_7
  gRNA
cuauaagcgagcaauuggcg

SEQ ID NO: 135399 - RNA, 20 nt, Artificial Sequence
  mmSKRIPTE0006178_Mink1_8
  gRNA
gagcggaaccgaaaccgugu

SEQ ID NO: 135400 - RNA, 20 nt, Artificial Sequence
  mmSKRIPTE0006179_Mink1_9
  gRNA
cccaacaguaccagucucgu

SEQ ID NO: 135401 - RNA, 20 nt, Artificial Sequence
  mmSKRIPTE0006180_Nlrp1b_1
  gRNA
gaaaggaaccuguaccggug

SEQ ID NO: 135402 - RNA, 20 nt, Artificial Sequence
  mmSKRIPTE0006181_Nlrp1b_2
  gRNA
agcguugcauacgaggccug

SEQ ID NO: 135403 - RNA, 20 nt, Artificial Sequence
  mmSKRIPTE0006182_Nlrp1b_3
  gRNA
acucccucuaaugccccgug

SEQ ID NO: 135404 - RNA, 20 nt, Artificial Sequence
  mmSKRIPTE0006183_Nlrp1b_4
  gRNA
uuggcagccaggguauauca

SEQ ID NO: 135405 - RNA, 20 nt, Artificial Sequence
  mmSKRIPTE0006184_Nlrp1b_5
  gRNA
cuguaagcaaggguuagacg

SEQ ID NO: 135406 - RNA, 20 nt, Artificial Sequence
  mmSKRIPTE0006185_Nlrp1b_6
  gRNA
ggguccucauaugaugcacu

SEQ ID NO: 135407 - RNA, 20 nt, Artificial Sequence
  mmSKRIPTE0006186_Nlrp1b_7
  gRNA
acaaaguggagucuugugcu

SEQ ID NO: 135408 - RNA, 20 nt, Artificial Sequence
  mmSKRIPTE0006187_Nlrp1b_8
  gRNA
accgcauucucaaaugagca

SEQ ID NO: 135409 - RNA, 20 nt, Artificial Sequence
  mmSKRIPTE0006188_Nlrp1b_9
  gRNA
aggauugcccaagcccucaa

SEQ ID NO: 135410 - RNA, 20 nt, Artificial Sequence
  mmSKRIPTE0006189_Grb2_1
  gRNA
aauacuucccggcuccgucg

SEQ ID NO: 135411 - RNA, 20 nt, Artificial Sequence
  mmSKRIPTE0006190_Grb2_2
  gRNA
aggccgaccucauggcagug

SEQ ID NO: 135412 - RNA, 20 nt, Artificial Sequence
  mmSKRIPTE0006191_Grb2_3
  gRNA
agaacuccugcucauacgug

SEQ ID NO: 135413 - RNA, 20 nt, Artificial Sequence
  mmSKRIPTE0006192_Grb2_4
  gRNA
gugcaggcacgugacuacag

SEQ ID NO: 135414 - RNA, 20 nt, Artificial Sequence
  mmSKRIPTE0006193_Grb2_5
  gRNA
ucucgggugaaccccaacca

SEQ ID NO: 135415 - RNA, 20 nt, Artificial Sequence
  mmSKRIPTE0006194_Grb2_6
  gRNA
uccaaacacaagacggucag

SEQ ID NO: 135416 - RNA, 20 nt, Artificial Sequence
  mmSKRIPTE0006195_Grb2_7
  gRNA
cccucacugugguaacacaa

SEQ ID NO: 135417 - RNA, 20 nt, Artificial Sequence
  mmSKRIPTE0006196_Grb2_8
  gRNA
aaacacuuacuugacggaca

SEQ ID NO: 135418 - RNA, 20 nt, Artificial Sequence
  mmSKRIPTE0006197_Grb2_9
  gRNA
auguaggccuauaagaguga

SEQ ID NO: 135419 - RNA, 20 nt, Artificial Sequence
  mmSKRIPTE0006198_Acun1_1
  gRNA
caacucccaccugcgcaaag

SEQ ID NO: 135420 - RNA, 20 nt, Artificial Sequence
  mmSKRIPTE0006199_Acun1_2
  gRNA
ucaaagccagaaaugccgcu

SEQ ID NO: 135421 - RNA, 20 nt, Artificial Sequence
  mmSKRIPTE0006200_Acun1_3
  gRNA
aguggaaucugaguccacgu

SEQ ID NO: 135422 - RNA, 20 nt, Artificial Sequence
  mmSKRIPTE0006201_Acun1_4
  gRNA
gcagcggccggaaagcaacg

SEQ ID NO: 135423 - RNA, 20 nt, Artificial Sequence
  mmSKRIPTE0006202_Acun1_5
  gRNA
aguuuacgaccuaauaguug

SEQ ID NO: 135424 - RNA, 20 nt, Artificial Sequence
  mmSKRIPTE0006203_Acun1_6
  gRNA
cacaggguaaggaugcgcaa

SEQ ID NO: 135425 - RNA, 20 nt, Artificial Sequence
  mmSKRIPTE0006204_Acun1_7
  gRNA
uaagaaacgcuuuggccgag

SEQ ID NO: 135426 - RNA, 20 nt, Artificial Sequence
  mmSKRIPTE0006205_Acun1_8
  gRNA
augugaguuaauaggcugaa

SEQ ID NO: 135427 - RNA, 20 nt, Artificial Sequence
  mmSKRIPTE0006206_Acun1_9
  gRNA
aacgugccggagugauccug

SEQ ID NO: 135428 - RNA, 20 nt, Artificial Sequence
  mmSKRIPTE0006207_Pgf_1
  gRNA
aguguacuuagugcgcgggg

SEQ ID NO: 135429 - RNA, 20 nt, Artificial Sequence
  mmSKRIPTE0006208_Pgf_2
  gRNA
gguuccucgugcucggacag

SEQ ID NO: 135430 - RNA, 20 nt, Artificial Sequence
  mmSKRIPTE0006209_Pgf_3
  gRNA
ucccggcagagacaaccggu

SEQ ID NO: 135431 - RNA, 20 nt, Artificial Sequence
  mmSKRIPTE0006210_Pgf_4
  gRNA
gaaauguggaucccgauugg

SEQ ID NO: 135432 - RNA, 20 nt, Artificial Sequence
  mmSKRIPTE0006211_Pgf_5
  gRNA
gggaugccuuagcugcuucg

SEQ ID NO: 135433 - RNA, 20 nt, Artificial Sequence
  mmSKRIPTE0006212_Pgf_6
  gRNA
agggggcacgucauucagca

SEQ ID NO: 135434 - RNA, 20 nt, Artificial Sequence
  mmSKRIPTE0006213_Pgf_7
  gRNA
guugcuccagcgccgcuagg

SEQ ID NO: 135435 - RNA, 20 nt, Artificial Sequence
  mmSKRIPTE0006214_Pgf_8
  gRNA
gugccuuucaacgaagugug

SEQ ID NO: 135436 - RNA, 20 nt, Artificial Sequence
  mmSKRIPTE0006215_Pgf_9
  gRNA
cgagucggcuaauaaauaga

SEQ ID NO: 135437 - RNA, 20 nt, Artificial Sequence
  mmSKRIPTE0006216_Yy1_1
  gRNA
cauaaaguaaguaaugcgag

SEQ ID NO: 135438 - RNA, 20 nt, Artificial Sequence
  mmSKRIPTE0006217_Yy1_2
  gRNA
ccacuucuuauuccccgggu

SEQ ID NO: 135439 - RNA, 20 nt, Artificial Sequence
  mmSKRIPTE0006218_Yy1_3
  gRNA
cgacuacauagagcagacgc

SEQ ID NO: 135440 - RNA, 20 nt, Artificial Sequence
  mmSKRIPTE0006219_Yy1_4
  gRNA
acugugaugagguccgugca

SEQ ID NO: 135441 - RNA, 20 nt, Artificial Sequence
  mmSKRIPTE0006220_Yy1_5
  gRNA
ucucgggauucagggcacgu

SEQ ID NO: 135442 - RNA, 20 nt, Artificial Sequence
  mmSKRIPTE0006221_Yy1_6
  gRNA
ucuuauuacaaccgucgaag

SEQ ID NO: 135443 - RNA, 20 nt, Artificial Sequence
  mmSKRIPTE0006222_Yy1_7
  gRNA
gucacaugcaguaaguaacc

SEQ ID NO: 135444 - RNA, 20 nt, Artificial Sequence
  mmSKRIPTE0006223_Yy1_8
  gRNA
ugggucgucuguguacucug

SEQ ID NO: 135445 - RNA, 20 nt, Artificial Sequence
  mmSKRIPTE0006224_Yy1_9
  gRNA
gcuuaguguuggugcuacaa

SEQ ID NO: 135446 - RNA, 20 nt, Artificial Sequence
  mmSKRIPTE0006225_Rcor1_1
  gRNA
augcaacgcucgcuggacaa

SEQ ID NO: 135447 - RNA, 20 nt, Artificial Sequence
  mmSKRIPTE0006226_Rcor1_2
  gRNA
guaugauaaaggugacgaug

SEQ ID NO: 135448 - RNA, 20 nt, Artificial Sequence
  mmSKRIPTE0006227_Rcor1_3
  gRNA
guccagcugucucagcaccg

SEQ ID NO: 135449 - RNA, 20 nt, Artificial Sequence
  mmSKRIPTE0006228_Rcor1_4
  gRNA
augaccuacccacgucagca

SEQ ID NO: 135450 - RNA, 20 nt, Artificial Sequence
  mmSKRIPTE0006229_Rcor1_5
  gRNA
guguuggccuucgguccgcg

SEQ ID NO: 135451 - RNA, 20 nt, Artificial Sequence
  mmSKRIPTE0006230_Rcor1_6
  gRNA
uuaauauacuaauguacggg

SEQ ID NO: 135452 - RNA, 20 nt, Artificial Sequence
  mmSKRIPTE0006231_Rcor1_7
  gRNA
cugagguccacguucccaug

SEQ ID NO: 135453 - RNA, 20 nt, Artificial Sequence
  mmSKRIPTE0006232_Rcor1_8
  gRNA
gcaaaaaggaaaccuccgaa

SEQ ID NO: 135454 - RNA, 20 nt, Artificial Sequence
  mmSKRIPTE0006233_Rcor1_9
  gRNA
agagaagcacggguacaaca

SEQ ID NO: 135455 - RNA, 20 nt, Artificial Sequence
  mmSKRIPTE0006234_Ighv8-5_1
  gRNA
cugcacgauugugaguacac

SEQ ID NO: 135456 - RNA, 20 nt, Artificial Sequence
  mmSKRIPTE0006235_Ighv8-5_2
  gRNA
gaacaucuuaauaaggaccu

SEQ ID NO: 135457 - RNA, 20 nt, Artificial Sequence
  mmSKRIPTE0006236_Ighv8-5_3
  gRNA
uacuauacagcugauaacug

SEQ ID NO: 135458 - RNA, 20 nt, Artificial Sequence
  mmSKRIPTE0006237_Ighv8-5_4
  gRNA
cuucuaauauggguauaggc

SEQ ID NO: 135459 - RNA, 20 nt, Artificial Sequence
  mmSKRIPTE0006238_Ighv8-5_5
  gRNA
uaucuuacgauauaauaaga

SEQ ID NO: 135460 - RNA, 20 nt, Artificial Sequence
  mmSKRIPTE0006239_Bmpr1a_1
  gRNA
guggccgacuagcccgugug

SEQ ID NO: 135461 - RNA, 20 nt, Artificial Sequence
  mmSKRIPTE0006240_Bmpr1a_2
  gRNA
gccaucaaagaacggaccug

SEQ ID NO: 135462 - RNA, 20 nt, Artificial Sequence
  mmSKRIPTE0006241_Bmpr1a_3
  gRNA
ugaccuaccuauaacaacag

SEQ ID NO: 135463 - RNA, 20 nt, Artificial Sequence
  mmSKRIPTE0006242_Bmpr1a_4
  gRNA
acucccugcaggaaucgugg

SEQ ID NO: 135464 - RNA, 20 nt, Artificial Sequence
  mmSKRIPTE0006243_Bmpr1a_5
  gRNA
gucguuguauuacaggaggu

SEQ ID NO: 135465 - RNA, 20 nt, Artificial Sequence
  mmSKRIPTE0006244_Bmpr1a_6
  gRNA
ggguaccauaaauuucugug

SEQ ID NO: 135466 - RNA, 20 nt, Artificial Sequence
  mmSKRIPTE0006245_Bmpr1a_7
  gRNA
ucauuuguaucacuaagaca

SEQ ID NO: 135467 - RNA, 20 nt, Artificial Sequence
  mmSKRIPTE0006246_Bmpr1a_8
  gRNA
uucugcugcaucguacaaag

SEQ ID NO: 135468 - RNA, 20 nt, Artificial Sequence
  mmSKRIPTE0006247_Bmpr1a_9
  gRNA
gaugugacguuguugcuaag

SEQ ID NO: 135469 - RNA, 20 nt, Artificial Sequence
  mmSKRIPTE0006248_Tob2_1
  gRNA
cugccagacgaguacaucca

SEQ ID NO: 135470 - RNA, 20 nt, Artificial Sequence
  mmSKRIPTE0006249_Tob2_2
  gRNA
cuacagagggaagacccgcg

SEQ ID NO: 135471 - RNA, 20 nt, Artificial Sequence
  mmSKRIPTE0006250_Tob2_3
  gRNA
ucccugccacguccucagcg

SEQ ID NO: 135472 - RNA, 20 nt, Artificial Sequence
  mmSKRIPTE0006251_Tob2_4
  gRNA
acuucagcaacuccgcugcg

SEQ ID NO: 135473 - RNA, 20 nt, Artificial Sequence
  mmSKRIPTE0006252_Tob2_5
  gRNA
gcuaggaaaaggauucgccc

SEQ ID NO: 135474 - RNA, 20 nt, Artificial Sequence
  mmSKRIPTE0006253_Tob2_6
  gRNA
ggaaagcagauucaugcgca

SEQ ID NO: 135475 - RNA, 20 nt, Artificial Sequence
  mmSKRIPTE0006254_Tob2_7
  gRNA
ugagugucgugggaaccgag

SEQ ID NO: 135476 - RNA, 20 nt, Artificial Sequence
  mmSKRIPTE0006255_Tob2_8
  gRNA
uggaaucccaaccuacgacu

SEQ ID NO: 135477 - RNA, 20 nt, Artificial Sequence
  mmSKRIPTE0006256_Tob2_9
  gRNA
ggagagagaccuccgucccg

SEQ ID NO: 135478 - RNA, 20 nt, Artificial Sequence
  mmSKRIPTE0006257_Il1rap_1
  gRNA
uuucauaauguacuacccga

SEQ ID NO: 135479 - RNA, 20 nt, Artificial Sequence
  mmSKRIPTE0006258_Il1rap_2
  gRNA
cggagcgcgauucaccgcgu

SEQ ID NO: 135480 - RNA, 20 nt, Artificial Sequence
  mmSKRIPTE0006259_Il1rap_3
  gRNA
cacacuacuaacuaguaggg

SEQ ID NO: 135481 - RNA, 20 nt, Artificial Sequence
  mmSKRIPTE0006260_Il1rap_4
  gRNA
aguucacagagucaucggcu

SEQ ID NO: 135482 - RNA, 20 nt, Artificial Sequence
  mmSKRIPTE0006261_Il1rap_5
  gRNA
uuacagucacaguccuggug

SEQ ID NO: 135483 - RNA, 20 nt, Artificial Sequence
  mmSKRIPTE0006262_Il1rap_6
  gRNA
guugcgccugagauccuccg

SEQ ID NO: 135484 - RNA, 20 nt, Artificial Sequence
  mmSKRIPTE0006263_Il1rap_7
  gRNA
agucacagacuccacccacg

SEQ ID NO: 135485 - RNA, 20 nt, Artificial Sequence
  mmSKRIPTE0006264_Il1rap_8
  gRNA
ugagacacggagcgagacug

SEQ ID NO: 135486 - RNA, 20 nt, Artificial Sequence
  mmSKRIPTE0006265_Il1rap_9
  gRNA
gcaauuacaccugcauguug

SEQ ID NO: 135487 - RNA, 20 nt, Artificial Sequence
  mmSKRIPTE0006266_Tnk2_1
  gRNA
uuggagccuauguucccucg

SEQ ID NO: 135488 - RNA, 20 nt, Artificial Sequence
  mmSKRIPTE0006267_Tnk2_2
  gRNA
ucagaggacugagcucccga

SEQ ID NO: 135489 - RNA, 20 nt, Artificial Sequence
  mmSKRIPTE0006268_Tnk2_3
  gRNA
ucgaaaugucgugaccuccg

SEQ ID NO: 135490 - RNA, 20 nt, Artificial Sequence
  mmSKRIPTE0006269_Tnk2_4
  gRNA
aauacgcggacccugugugu

SEQ ID NO: 135491 - RNA, 20 nt, Artificial Sequence
  mmSKRIPTE0006270_Tnk2_5
  gRNA
cacacucaucgacuucggug

SEQ ID NO: 135492 - RNA, 20 nt, Artificial Sequence
  mmSKRIPTE0006271_Tnk2_6
  gRNA
aguggcauacuuagggucug

SEQ ID NO: 135493 - RNA, 20 nt, Artificial Sequence
  mmSKRIPTE0006272_Tnk2_7
  gRNA
uccauacgagaucuugugug

SEQ ID NO: 135494 - RNA, 20 nt, Artificial Sequence
  mmSKRIPTE0006273_Tnk2_8
  gRNA
ugguaaauaccggguauagg

SEQ ID NO: 135495 - RNA, 20 nt, Artificial Sequence
  mmSKRIPTE0006274_Tnk2_9
  gRNA
cugucagucuaaucccccag

SEQ ID NO: 135496 - RNA, 20 nt, Artificial Sequence
  mmSKRIPTE0006275_Cxadr_1
  gRNA
uagccaaagaacgguaccag

SEQ ID NO: 135497 - RNA, 20 nt, Artificial Sequence
  mmSKRIPTE0006276_Cxadr_2
  gRNA
gagccugguacacucccgac

SEQ ID NO: 135498 - RNA, 20 nt, Artificial Sequence
  mmSKRIPTE0006277_Cxadr_3
  gRNA
gcggccucccgggaacaaug

SEQ ID NO: 135499 - RNA, 20 nt, Artificial Sequence
  mmSKRIPTE0006278_Cxadr_4
  gRNA
cgcaagcgacugggacggag

SEQ ID NO: 135500 - RNA, 20 nt, Artificial Sequence
  mmSKRIPTE0006279_Cxadr_5
  gRNA
caucaauggacucauuacaa

SEQ ID NO: 135501 - RNA, 20 nt, Artificial Sequence
  mmSKRIPTE0006280_Cxadr_6
  gRNA
ucucuuaucugaguagugug

SEQ ID NO: 135502 - RNA, 20 nt, Artificial Sequence
  mmSKRIPTE0006281_Cxadr_7
  gRNA
ugcucccaugaauagccccg

SEQ ID NO: 135503 - RNA, 20 nt, Artificial Sequence
  mmSKRIPTE0006282_Cxadr_8
  gRNA
gcaucacuacacccgaacag

SEQ ID NO: 135504 - RNA, 20 nt, Artificial Sequence
  mmSKRIPTE0006283_Cxadr_9
  gRNA
aucguuccuauuauccacag

SEQ ID NO: 135505 - RNA, 20 nt, Artificial Sequence
  mmSKRIPTE0006284_Dll1_1
  gRNA
augcuugauaaccggaagug

SEQ ID NO: 135506 - RNA, 20 nt, Artificial Sequence
  mmSKRIPTE0006285_Dll1_2
  gRNA
ccaugcgagaacacacaccg

SEQ ID NO: 135507 - RNA, 20 nt, Artificial Sequence
  mmSKRIPTE0006286_Dll1_3
  gRNA
auccccaagucaauuccgug

SEQ ID NO: 135508 - RNA, 20 nt, Artificial Sequence
  mmSKRIPTE0006287_Dll1_4
  gRNA
cagcguaagaaagccgcgug

SEQ ID NO: 135509 - RNA, 20 nt, Artificial Sequence
  mmSKRIPTE0006288_Dll1_5
  gRNA
aguaucaccagguggaacug

SEQ ID NO: 135510 - RNA, 20 nt, Artificial Sequence
  mmSKRIPTE0006289_Dll1_6
  gRNA
uccccggcaagagcucuacg

SEQ ID NO: 135511 - RNA, 20 nt, Artificial Sequence
  mmSKRIPTE0006290_Dll1_7
  gRNA
ucuaacggugaggggcaaug

SEQ ID NO: 135512 - RNA, 20 nt, Artificial Sequence
  mmSKRIPTE0006291_Dll1_8
  gRNA
ccuucaugaagacaucgaug

SEQ ID NO: 135513 - RNA, 20 nt, Artificial Sequence
  mmSKRIPTE0006292_Dll1_9
  gRNA
gucuggaaaucccaccggug

SEQ ID NO: 135514 - RNA, 20 nt, Artificial Sequence
  mmSKRIPTE0006293_Il1f6_1
  gRNA
aggaucuuaguagucgugug

SEQ ID NO: 135515 - RNA, 20 nt, Artificial Sequence
  mmSKRIPTE0006294_Il1f6_2
  gRNA
gagcugccuguucugcacaa

SEQ ID NO: 135516 - RNA, 20 nt, Artificial Sequence
  mmSKRIPTE0006295_Il1f6_3
  gRNA
cacugacuucgagaugauug

SEQ ID NO: 135517 - RNA, 20 nt, Artificial Sequence
  mmSKRIPTE0006296_Il1f6_4
  gRNA
ccuaagucacaguuugaccc

SEQ ID NO: 135518 - RNA, 20 nt, Artificial Sequence
  mmSKRIPTE0006297_Il1f6_5
  gRNA
cagguuagaaacgcagccug

SEQ ID NO: 135519 - RNA, 20 nt, Artificial Sequence
  mmSKRIPTE0006298_Il1f6_6
  gRNA
acacaccagugggcucagag

SEQ ID NO: 135520 - RNA, 20 nt, Artificial Sequence
  mmSKRIPTE0006299_Il1f6_7
  gRNA
cugcaucugauucaccacca

SEQ ID NO: 135521 - RNA, 20 nt, Artificial Sequence
  mmSKRIPTE0006300_Il1f6_8
  gRNA
agaguguccagauauuggca

SEQ ID NO: 135522 - RNA, 20 nt, Artificial Sequence
  mmSKRIPTE0006301_Il1f6_9
  gRNA
cagcaguccuaggugcacug

SEQ ID NO: 135523 - RNA, 20 nt, Artificial Sequence
  mmSKRIPTE0006302_Vcam1_1
  gRNA
acuuacaguagauguccacg

SEQ ID NO: 135524 - RNA, 20 nt, Artificial Sequence
  mmSKRIPTE0006303_Vcam1_2
  gRNA
gacaaugaccuguuccagcg

SEQ ID NO: 135525 - RNA, 20 nt, Artificial Sequence
  mmSKRIPTE0006304_Vcam1_3
  gRNA
agccacucccaggaauucag

SEQ ID NO: 135526 - RNA, 20 nt, Artificial Sequence
  mmSKRIPTE0006305_Vcam1_4
  gRNA
gugguggucugcgauuggga

SEQ ID NO: 135527 - RNA, 20 nt, Artificial Sequence
  mmSKRIPTE0006306_Vcam1_5
  gRNA
cagcugaagggguuaacgug

SEQ ID NO: 135528 - RNA, 20 nt, Artificial Sequence
  mmSKRIPTE0006307_Vcam1_6
  gRNA
agacagcccacuaaacgcga

SEQ ID NO: 135529 - RNA, 20 nt, Artificial Sequence
  mmSKRIPTE0006308_Vcam1_7
  gRNA
auacagcugauguuugagga

SEQ ID NO: 135530 - RNA, 20 nt, Artificial Sequence
  mmSKRIPTE0006309_Vcam1_8
  gRNA
gagucauuacgaaauuagac

SEQ ID NO: 135531 - RNA, 20 nt, Artificial Sequence
  mmSKRIPTE0006310_Vcam1_9
  gRNA
uuagguaacgguaagacggu

SEQ ID NO: 135532 - RNA, 20 nt, Artificial Sequence
  mmSKRIPTE0006311_Tgfbr1_1
  gRNA
agagcguucaugguuccgag

SEQ ID NO: 135533 - RNA, 20 nt, Artificial Sequence
  mmSKRIPTE0006312_Tgfbr1_2
  gRNA
ccucuucauuuggcacacgg

SEQ ID NO: 135534 - RNA, 20 nt, Artificial Sequence
  mmSKRIPTE0006313_Tgfbr1_3
  gRNA
uuucuucccuuucgacacag

SEQ ID NO: 135535 - RNA, 20 nt, Artificial Sequence
  mmSKRIPTE0006314_Tgfbr1_4
  gRNA
aaaauguaacugaaacaccg

SEQ ID NO: 135536 - RNA, 20 nt, Artificial Sequence
  mmSKRIPTE0006315_Tgfbr1_5
  gRNA
guuuggcgaggcaaauggcg

SEQ ID NO: 135537 - RNA, 20 nt, Artificial Sequence
  mmSKRIPTE0006316_Tgfbr1_6
  gRNA
guguucugacgugcagacaa

SEQ ID NO: 135538 - RNA, 20 nt, Artificial Sequence
  mmSKRIPTE0006317_Tgfbr1_7
  gRNA
ugucugcugcuauaaauccc

SEQ ID NO: 135539 - RNA, 20 nt, Artificial Sequence
  mmSKRIPTE0006318_Tgfbr1_8
  gRNA
gguaugccaauggagcagca

SEQ ID NO: 135540 - RNA, 20 nt, Artificial Sequence
  mmSKRIPTE0006319_Tgfbr1_9
  gRNA
aaggaauaguacuugccugu

SEQ ID NO: 135541 - RNA, 20 nt, Artificial Sequence
  mmSKRIPTE0006320_Tlr6_1
  gRNA
ccauugauguuacaacaaug

SEQ ID NO: 135542 - RNA, 20 nt, Artificial Sequence
  mmSKRIPTE0006321_Tlr6_2
  gRNA
cuacugagaagggcaaacgu

SEQ ID NO: 135543 - RNA, 20 nt, Artificial Sequence
  mmSKRIPTE0006322_Tlr6_3
  gRNA
uaaauauugagguacuccac

SEQ ID NO: 135544 - RNA, 20 nt, Artificial Sequence
  mmSKRIPTE0006323_Tlr6_4
  gRNA
cucaaguucauuagagaacg

SEQ ID NO: 135545 - RNA, 20 nt, Artificial Sequence
  mmSKRIPTE0006324_Tlr6_5
  gRNA
gaguuaucauauaaaaggcg

SEQ ID NO: 135546 - RNA, 20 nt, Artificial Sequence
  mmSKRIPTE0006325_Tlr6_6
  gRNA
ggaaccacgguacuuaggag

SEQ ID NO: 135547 - RNA, 20 nt, Artificial Sequence
  mmSKRIPTE0006326_Tlr6_7
  gRNA
auaugacaggacaugcgccu

SEQ ID NO: 135548 - RNA, 20 nt, Artificial Sequence
  mmSKRIPTE0006327_Tlr6_8
  gRNA
gauaacugagagaaucgaca

SEQ ID NO: 135549 - RNA, 20 nt, Artificial Sequence
  mmSKRIPTE0006328_Tlr6_9
  gRNA
guuucagcucuugaugccaa

SEQ ID NO: 135550 - RNA, 20 nt, Artificial Sequence
  mmSKRIPTE0006329_Tac1_1
  gRNA
cuccacaaagucuaccgggg

SEQ ID NO: 135551 - RNA, 20 nt, Artificial Sequence
  mmSKRIPTE0006330_Tac1_2
  gRNA
cucacugcggucagaccgcg

SEQ ID NO: 135552 - RNA, 20 nt, Artificial Sequence
  mmSKRIPTE0006331_Tac1_3
  gRNA
uuuccgagacgguaacccgu

SEQ ID NO: 135553 - RNA, 20 nt, Artificial Sequence
  mmSKRIPTE0006332_Tac1_4
  gRNA
ucacuaacucuagaucgugg

SEQ ID NO: 135554 - RNA, 20 nt, Artificial Sequence
  mmSKRIPTE0006333_Tac1_5
  gRNA
guuuggagaaguguucgacc

SEQ ID NO: 135555 - RNA, 20 nt, Artificial Sequence
  mmSKRIPTE0006334_Tac1_6
  gRNA
gugauguagaguuuccgaga

SEQ ID NO: 135556 - RNA, 20 nt, Artificial Sequence
  mmSKRIPTE0006335_Tac1_7
  gRNA
uaagccuuguaauucuaaug

SEQ ID NO: 135557 - RNA, 20 nt, Artificial Sequence
  mmSKRIPTE0006336_Tac1_8
  gRNA
ccuaacugugaacaguaggg

SEQ ID NO: 135558 - RNA, 20 nt, Artificial Sequence
  mmSKRIPTE0006337_Tac1_9
  gRNA
ucgcggguuugucccccagg

SEQ ID NO: 135559 - RNA, 20 nt, Artificial Sequence
  mmSKRIPTE0006338_Raf1_1
  gRNA
ccaacuaaugagaccacgug

SEQ ID NO: 135560 - RNA, 20 nt, Artificial Sequence
  mmSKRIPTE0006339_Raf1_2
  gRNA
uguggauggcuuuccaagcg

SEQ ID NO: 135561 - RNA, 20 nt, Artificial Sequence
  mmSKRIPTE0006340_Raf1_3
  gRNA
ucaucuucaugguaggccgu

SEQ ID NO: 135562 - RNA, 20 nt, Artificial Sequence
  mmSKRIPTE0006341_Raf1_4
  gRNA
accuggcgauugugacucag

SEQ ID NO: 135563 - RNA, 20 nt, Artificial Sequence
  mmSKRIPTE0006342_Raf1_5
  gRNA
gacccaguuacgucucaacc

SEQ ID NO: 135564 - RNA, 20 nt, Artificial Sequence
  mmSKRIPTE0006343_Raf1_6
  gRNA
uggcaacagugaagucacgc

SEQ ID NO: 135565 - RNA, 20 nt, Artificial Sequence
  mmSKRIPTE0006344_Raf1_7
  gRNA
ggaagacagauucagcacgu

SEQ ID NO: 135566 - RNA, 20 nt, Artificial Sequence
  mmSKRIPTE0006345_Raf1_8
  gRNA
uuuccagaauauaaguacgc

SEQ ID NO: 135567 - RNA, 20 nt, Artificial Sequence
  mmSKRIPTE0006346_Raf1_9
  gRNA
gagagacucgaguuauuacu

SEQ ID NO: 135568 - RNA, 20 nt, Artificial Sequence
  mmSKRIPTE0006347_Irf3_1
  gRNA
ccaguggugccuacaccccg

SEQ ID NO: 135569 - RNA, 20 nt, Artificial Sequence
  mmSKRIPTE0006348_Irf3_2
  gRNA
uugcccgauccugcgcccug

SEQ ID NO: 135570 - RNA, 20 nt, Artificial Sequence
  mmSKRIPTE0006349_Irf3_3
  gRNA
guuaggauccuuuaaagacg

SEQ ID NO: 135571 - RNA, 20 nt, Artificial Sequence
  mmSKRIPTE0006350_Irf3_4
  gRNA
aggcuuccgucuacaacgcg

SEQ ID NO: 135572 - RNA, 20 nt, Artificial Sequence
  mmSKRIPTE0006351_Irf3_5
  gRNA
ucuuccgcguuaccuaccag

SEQ ID NO: 135573 - RNA, 20 nt, Artificial Sequence
  mmSKRIPTE0006352_Irf3_6
  gRNA
ucuuggggcacuauccacug

SEQ ID NO: 135574 - RNA, 20 nt, Artificial Sequence
  mmSKRIPTE0006353_Irf3_7
  gRNA
gaaccacagaguguagcgug

SEQ ID NO: 135575 - RNA, 20 nt, Artificial Sequence
  mmSKRIPTE0006354_Irf3_8
  gRNA
acgacuuagacucuggcccg

SEQ ID NO: 135576 - RNA, 20 nt, Artificial Sequence
  mmSKRIPTE0006355_Irf3_9
  gRNA
agccucuucacugaaaaccg

SEQ ID NO: 135577 - RNA, 20 nt, Artificial Sequence
  mmSKRIPTE0006356_Rab6a_1
  gRNA
caaucccggcuccucccgug

SEQ ID NO: 135578 - RNA, 20 nt, Artificial Sequence
  mmSKRIPTE0006357_Rab6a_2
  gRNA
ccuucccucagaacgcggcg

SEQ ID NO: 135579 - RNA, 20 nt, Artificial Sequence
  mmSKRIPTE0006358_Rab6a_3
  gRNA
ugcuaggcgacucugcgggg

SEQ ID NO: 135580 - RNA, 20 nt, Artificial Sequence
  mmSKRIPTE0006359_Rab6a_4
  gRNA
ugagcguacugguacaaaca

SEQ ID NO: 135581 - RNA, 20 nt, Artificial Sequence
  mmSKRIPTE0006360_Rab6a_5
  gRNA
ccugauagauccuagcgagg

SEQ ID NO: 135582 - RNA, 20 nt, Artificial Sequence
  mmSKRIPTE0006361_Rab6a_6
  gRNA
uaggaagagcgaggccggcg

SEQ ID NO: 135583 - RNA, 20 nt, Artificial Sequence
  mmSKRIPTE0006362_Rab6a_7
  gRNA
acaaguagguauacugcgau

SEQ ID NO: 135584 - RNA, 20 nt, Artificial Sequence
  mmSKRIPTE0006363_Rab6a_8
  gRNA
gagacuucgggaauccgcug

SEQ ID NO: 135585 - RNA, 20 nt, Artificial Sequence
  mmSKRIPTE0006364_Rab6a_9
  gRNA
gcuccaacccgcuaacgaag

SEQ ID NO: 135586 - RNA, 20 nt, Artificial Sequence
  mmSKRIPTE0006365_Cklf_1
  gRNA
gccuugcgucuggaaaggcg

SEQ ID NO: 135587 - RNA, 20 nt, Artificial Sequence
  mmSKRIPTE0006366_Cklf_2
  gRNA
cgguagucaggagugcuccg

SEQ ID NO: 135588 - RNA, 20 nt, Artificial Sequence
  mmSKRIPTE0006367_Cklf_3
  gRNA
gaaagagccauuaaucgaga

SEQ ID NO: 135589 - RNA, 20 nt, Artificial Sequence
  mmSKRIPTE0006368_Cklf_4
  gRNA
gcuaaucaauccaagcuugg

SEQ ID NO: 135590 - RNA, 20 nt, Artificial Sequence
  mmSKRIPTE0006369_Cklf_5
  gRNA
uuccuagucuuauacacgug

SEQ ID NO: 135591 - RNA, 20 nt, Artificial Sequence
  mmSKRIPTE0006370_Cklf_6
  gRNA
cacggccggucguaagccgu

SEQ ID NO: 135592 - RNA, 20 nt, Artificial Sequence
  mmSKRIPTE0006371_Cklf_7
  gRNA
aguuaggaacuuaagagacc

SEQ ID NO: 135593 - RNA, 20 nt, Artificial Sequence
  mmSKRIPTE0006372_Cklf_8
  gRNA
gcaaggcauugauugcucug

SEQ ID NO: 135594 - RNA, 20 nt, Artificial Sequence
  mmSKRIPTE0006373_Cklf_9
  gRNA
accagggcgggaaugcaggg

SEQ ID NO: 135595 - RNA, 20 nt, Artificial Sequence
  mmSKRIPTE0006374_Hprt_1
  gRNA
cuagaaugaucagucaacgg

SEQ ID NO: 135596 - RNA, 20 nt, Artificial Sequence
  mmSKRIPTE0006375_Hprt_2
  gRNA
augaccugcaauacuugcug

SEQ ID NO: 135597 - RNA, 20 nt, Artificial Sequence
  mmSKRIPTE0006376_Hprt_3
  gRNA
auaagcgacaaucuaccaga

SEQ ID NO: 135598 - RNA, 20 nt, Artificial Sequence
  mmSKRIPTE0006377_Hprt_4
  gRNA
uccagguggugaucagucgg

SEQ ID NO: 135599 - RNA, 20 nt, Artificial Sequence
  mmSKRIPTE0006378_Hprt_5
  gRNA
aucagucgggucaaauuacg

SEQ ID NO: 135600 - RNA, 20 nt, Artificial Sequence
  mmSKRIPTE0006379_Hprt_6
  gRNA
ucgcggcaaaaagcggucug

SEQ ID NO: 135601 - RNA, 20 nt, Artificial Sequence
  mmSKRIPTE0006380_Hprt_7
  gRNA
uucagcaguaagacgcagca

SEQ ID NO: 135602 - RNA, 20 nt, Artificial Sequence
  mmSKRIPTE0006381_Hprt_8
  gRNA
uagcagguguucuaguccug

SEQ ID NO: 135603 - RNA, 20 nt, Artificial Sequence
  mmSKRIPTE0006382_Hprt_9
  gRNA
auggauaaaugauuggccaa

SEQ ID NO: 135604 - RNA, 20 nt, Artificial Sequence
  mmSKRIPTE0006383_Irak1_1
  gRNA
cuccucaggcaaguaggcga

SEQ ID NO: 135605 - RNA, 20 nt, Artificial Sequence
  mmSKRIPTE0006384_Irak1_2
  gRNA
uuggcuucugcucaccaccg

SEQ ID NO: 135606 - RNA, 20 nt, Artificial Sequence
  mmSKRIPTE0006385_Irak1_3
  gRNA
gcgcacgaucaaggccgcug

SEQ ID NO: 135607 - RNA, 20 nt, Artificial Sequence
  mmSKRIPTE0006386_Irak1_4
  gRNA
caaacuccucaguagcccaa

SEQ ID NO: 135608 - RNA, 20 nt, Artificial Sequence
  mmSKRIPTE0006387_Irak1_5
  gRNA
cccaccgaacuggcaccagu

SEQ ID NO: 135609 - RNA, 20 nt, Artificial Sequence
  mmSKRIPTE0006388_Irak1_6
  gRNA
gcuggguugaugaugaucug

SEQ ID NO: 135610 - RNA, 20 nt, Artificial Sequence
  mmSKRIPTE0006389_Irak1_7
  gRNA
aagagaccauggaccaggcg

SEQ ID NO: 135611 - RNA, 20 nt, Artificial Sequence
  mmSKRIPTE0006390_Irak1_8
  gRNA
gcucuuguggucacuacuag

SEQ ID NO: 135612 - RNA, 20 nt, Artificial Sequence
  mmSKRIPTE0006391_Irak1_9
  gRNA
gggucuccaguauuaccuag

SEQ ID NO: 135613 - RNA, 20 nt, Artificial Sequence
  mmSKRIPTE0006392_Rab5b_1
  gRNA
caaacaagacgacuauugag

SEQ ID NO: 135614 - RNA, 20 nt, Artificial Sequence
  mmSKRIPTE0006393_Rab5b_2
  gRNA
auuacuauauuaugggucca

SEQ ID NO: 135615 - RNA, 20 nt, Artificial Sequence
  mmSKRIPTE0006394_Rab5b_3
  gRNA
gcaagaucacccgccuaccg

SEQ ID NO: 135616 - RNA, 20 nt, Artificial Sequence
  mmSKRIPTE0006395_Rab5b_4
  gRNA
acacuaacccuguagcuggu

SEQ ID NO: 135617 - RNA, 20 nt, Artificial Sequence
  mmSKRIPTE0006396_Rab5b_5
  gRNA
cucguguagguauuggcuug

SEQ ID NO: 135618 - RNA, 20 nt, Artificial Sequence
  mmSKRIPTE0006397_Rab5b_6
  gRNA
ucgacuaguuagaggugcca

SEQ ID NO: 135619 - RNA, 20 nt, Artificial Sequence
  mmSKRIPTE0006398_Rab5b_7
  gRNA
cgagcugauggagcccacaa

SEQ ID NO: 135620 - RNA, 20 nt, Artificial Sequence
  mmSKRIPTE0006399_Rab5b_8
  gRNA
ggcugagaaagugaugauug

SEQ ID NO: 135621 - RNA, 20 nt, Artificial Sequence
  mmSKRIPTE0006400_Rab5b_9
  gRNA
ucagcgcccacuaggccugu

SEQ ID NO: 135622 - RNA, 20 nt, Artificial Sequence
  mmSKRIPTE0006401_Lif_1
  gRNA
acacuaccuacuaugcucgg

SEQ ID NO: 135623 - RNA, 20 nt, Artificial Sequence
  mmSKRIPTE0006402_Lif_2
  gRNA
cgcuaccaugcaagacuccg

SEQ ID NO: 135624 - RNA, 20 nt, Artificial Sequence
  mmSKRIPTE0006403_Lif_3
  gRNA
augaggugccacuaagagag

SEQ ID NO: 135625 - RNA, 20 nt, Artificial Sequence
  mmSKRIPTE0006404_Lif_4
  gRNA
ccuuccucaaaucguagcug

SEQ ID NO: 135626 - RNA, 20 nt, Artificial Sequence
  mmSKRIPTE0006405_Lif_5
  gRNA
ucugugcaacaaguaccgug

SEQ ID NO: 135627 - RNA, 20 nt, Artificial Sequence
  mmSKRIPTE0006406_Lif_6
  gRNA
acauuguuaaaugcaaaacg

SEQ ID NO: 135628 - RNA, 20 nt, Artificial Sequence
  mmSKRIPTE0006407_Lif_7
  gRNA
gcaaguuggggugagcggcg

SEQ ID NO: 135629 - RNA, 20 nt, Artificial Sequence
  mmSKRIPTE0006408_Lif_8
  gRNA
gguucugcacuggaaacacg

SEQ ID NO: 135630 - RNA, 20 nt, Artificial Sequence
  mmSKRIPTE0006409_Lif_9
  gRNA
aggagccucauaccauuucg

SEQ ID NO: 135631 - RNA, 20 nt, Artificial Sequence
  mmSKRIPTE0006410_Ighg1_1
  gRNA
guguuugucccaauaaggug

SEQ ID NO: 135632 - RNA, 20 nt, Artificial Sequence
  mmSKRIPTE0006411_Ighg1_2
  gRNA
guggagugagucuacuacac

SEQ ID NO: 135633 - RNA, 20 nt, Artificial Sequence
  mmSKRIPTE0006412_Ighg1_3
  gRNA
uuagccugccuaaaccaacc

SEQ ID NO: 135634 - RNA, 20 nt, Artificial Sequence
  mmSKRIPTE0006413_Ighg1_4
  gRNA
cagaugagcuaccuaucuag

SEQ ID NO: 135635 - RNA, 20 nt, Artificial Sequence
  mmSKRIPTE0006414_Ighg1_5
  gRNA
uggucacagaugcaauacac

SEQ ID NO: 135636 - RNA, 20 nt, Artificial Sequence
  mmSKRIPTE0006415_Ighg1_6
  gRNA
gguuuaucgaaguguuaagg

SEQ ID NO: 135637 - RNA, 20 nt, Artificial Sequence
  mmSKRIPTE0006416_Ighg1_7
  gRNA
uuacauagcauguaagacug

SEQ ID NO: 135638 - RNA, 20 nt, Artificial Sequence
  mmSKRIPTE0006417_Ighg1_8
  gRNA
ggcuuacaaccacaaucccu

SEQ ID NO: 135639 - RNA, 20 nt, Artificial Sequence
  mmSKRIPTE0006418_Ighg1_9
  gRNA
gugacuaaggaaaaacccau

SEQ ID NO: 135640 - RNA, 20 nt, Artificial Sequence
  mmSKRIPTE0006419_Ighv15-2_1
  gRNA
cauuugaaauggcggcaaag

SEQ ID NO: 135641 - RNA, 20 nt, Artificial Sequence
  mmSKRIPTE0006420_Ighv15-2_2
  gRNA
uagacuagaggguacuaaug

SEQ ID NO: 135642 - RNA, 20 nt, Artificial Sequence
  mmSKRIPTE0006421_Ighv15-2_3
  gRNA
gacaccuagaguuaggcaug

SEQ ID NO: 135643 - RNA, 20 nt, Artificial Sequence
  mmSKRIPTE0006422_Ighv15-2_4
  gRNA
ugugcacagagguucuaaca

SEQ ID NO: 135644 - RNA, 20 nt, Artificial Sequence
  mmSKRIPTE0006423_Ighv15-2_5
  gRNA
gcucaacagucugacauccg

SEQ ID NO: 135645 - RNA, 20 nt, Artificial Sequence
  mmSKRIPTE0006424_Ighv15-2_6
  gRNA
aagcaguugcucaaagccug

SEQ ID NO: 135646 - RNA, 20 nt, Artificial Sequence
  mmSKRIPTE0006425_Ighv15-2_7
  gRNA
aagcaugucaaaaagucuga

SEQ ID NO: 135647 - RNA, 20 nt, Artificial Sequence
  mmSKRIPTE0006426_Ighv15-2_8
  gRNA
agacuguuguaggugaaccu

SEQ ID NO: 135648 - RNA, 20 nt, Artificial Sequence
  mmSKRIPTE0006427_Ighv15-2_9
  gRNA
aauauguaaaucaugguuug

SEQ ID NO: 135649 - RNA, 20 nt, Artificial Sequence
  mmSKRIPTE0006428_Pik3r1_1
  gRNA
uccguaguguaaguagccca

SEQ ID NO: 135650 - RNA, 20 nt, Artificial Sequence
  mmSKRIPTE0006429_Pik3r1_2
  gRNA
ggaccuuguaugguguacgu

SEQ ID NO: 135651 - RNA, 20 nt, Artificial Sequence
  mmSKRIPTE0006430_Pik3r1_3
  gRNA
gaaagcguuaacaagcacca

SEQ ID NO: 135652 - RNA, 20 nt, Artificial Sequence
  mmSKRIPTE0006431_Pik3r1_4
  gRNA
cuaaacccagaugcacgaag

SEQ ID NO: 135653 - RNA, 20 nt, Artificial Sequence
  mmSKRIPTE0006432_Pik3r1_5
  gRNA
ugagagccuacaugucacgc

SEQ ID NO: 135654 - RNA, 20 nt, Artificial Sequence
  mmSKRIPTE0006433_Pik3r1_6
  gRNA
cuauugcgagggaagcgaga

SEQ ID NO: 135655 - RNA, 20 nt, Artificial Sequence
  mmSKRIPTE0006434_Pik3r1_7
  gRNA
agagccgcgucugcucacgc

SEQ ID NO: 135656 - RNA, 20 nt, Artificial Sequence
  mmSKRIPTE0006435_Pik3r1_8
  gRNA
acccaguauaugcacaacag

SEQ ID NO: 135657 - RNA, 20 nt, Artificial Sequence
  mmSKRIPTE0006436_Pik3r1_9
  gRNA
gucuuccauaguccaaaccg

SEQ ID NO: 135658 - RNA, 20 nt, Artificial Sequence
  mmSKRIPTE0006437_Pnp_1
  gRNA
ggggccugccaacaucacgu

SEQ ID NO: 135659 - RNA, 20 nt, Artificial Sequence
  mmSKRIPTE0006438_Pnp_2
  gRNA
ugacucagacagugucgccg

SEQ ID NO: 135660 - RNA, 20 nt, Artificial Sequence
  mmSKRIPTE0006439_Pnp_3
  gRNA
agcauuccacucccggaucg

SEQ ID NO: 135661 - RNA, 20 nt, Artificial Sequence
  mmSKRIPTE0006440_Pnp_4
  gRNA
aaugaaggcgucaguaccug

SEQ ID NO: 135662 - RNA, 20 nt, Artificial Sequence
  mmSKRIPTE0006441_Pnp_5
  gRNA
uagugcacuauucgcugggc

SEQ ID NO: 135663 - RNA, 20 nt, Artificial Sequence
  mmSKRIPTE0006442_Pnp_6
  gRNA
auggaguaaauggagaacgu

SEQ ID NO: 135664 - RNA, 20 nt, Artificial Sequence
  mmSKRIPTE0006443_Pnp_7
  gRNA
cuaguaaggcuaccugagag

SEQ ID NO: 135665 - RNA, 20 nt, Artificial Sequence
  mmSKRIPTE0006444_Pnp_8
  gRNA
cauggagaacgaguaagugc

SEQ ID NO: 135666 - RNA, 20 nt, Artificial Sequence
  mmSKRIPTE0006445_Pnp_9
  gRNA
auccugcccuuuccgcucca

SEQ ID NO: 135667 - RNA, 20 nt, Artificial Sequence
  mmSKRIPTE0006446_Ticam1_1
  gRNA
ucccugaagacgauagagug

SEQ ID NO: 135668 - RNA, 20 nt, Artificial Sequence
  mmSKRIPTE0006447_Ticam1_2
  gRNA
aagaugccaucgaucacucg

SEQ ID NO: 135669 - RNA, 20 nt, Artificial Sequence
  mmSKRIPTE0006448_Ticam1_3
  gRNA
ucuggaacgcuaauuucgug

SEQ ID NO: 135670 - RNA, 20 nt, Artificial Sequence
  mmSKRIPTE0006449_Ticam1_4
  gRNA
aacccagggccuucgcuccg

SEQ ID NO: 135671 - RNA, 20 nt, Artificial Sequence
  mmSKRIPTE0006450_Ticam1_5
  gRNA
aaguuuacgaggcugcgcug

SEQ ID NO: 135672 - RNA, 20 nt, Artificial Sequence
  mmSKRIPTE0006451_Ticam1_6
  gRNA
ugggcauggugaauaaugag

SEQ ID NO: 135673 - RNA, 20 nt, Artificial Sequence
  mmSKRIPTE0006452_Ticam1_7
  gRNA
ggaggcagagcggcaaaacg

SEQ ID NO: 135674 - RNA, 20 nt, Artificial Sequence
  mmSKRIPTE0006453_Ticam1_8
  gRNA
aaguccugccuaguuccacg

SEQ ID NO: 135675 - RNA, 20 nt, Artificial Sequence
  mmSKRIPTE0006454_Ticam1_9
  gRNA
ucuggugugucaaugggacg

SEQ ID NO: 135676 - RNA, 20 nt, Artificial Sequence
  mmSKRIPTE0006455_Hspa9_1
  gRNA
ccguucucccuacugacgug

SEQ ID NO: 135677 - RNA, 20 nt, Artificial Sequence
  mmSKRIPTE0006456_Hspa9_2
  gRNA
guaaagacuuaggaacgcca

SEQ ID NO: 135678 - RNA, 20 nt, Artificial Sequence
  mmSKRIPTE0006457_Hspa9_3
  gRNA
aaggauauuuagacucgaug

SEQ ID NO: 135679 - RNA, 20 nt, Artificial Sequence
  mmSKRIPTE0006458_Hspa9_4
  gRNA
aaccaguggugacuaagcag

SEQ ID NO: 135680 - RNA, 20 nt, Artificial Sequence
  mmSKRIPTE0006459_Hspa9_5
  gRNA
acuguaaauagaaugucacg

SEQ ID NO: 135681 - RNA, 20 nt, Artificial Sequence
  mmSKRIPTE0006460_Hspa9_6
  gRNA
ucugcugaaccuaagcauca

SEQ ID NO: 135682 - RNA, 20 nt, Artificial Sequence
  mmSKRIPTE0006461_Hspa9_7
  gRNA
uauguacuuaaugccagacu

SEQ ID NO: 135683 - RNA, 20 nt, Artificial Sequence
  mmSKRIPTE0006462_Hspa9_8
  gRNA
uuucaacgauuaaugcugag

SEQ ID NO: 135684 - RNA, 20 nt, Artificial Sequence
  mmSKRIPTE0006463_Hspa9_9
  gRNA
caacuugccauaccuuacca

SEQ ID NO: 135685 - RNA, 20 nt, Artificial Sequence
  mmSKRIPTE0006464_Hhex_1
  gRNA
gacugaaacagguaucgaca

SEQ ID NO: 135686 - RNA, 20 nt, Artificial Sequence
  mmSKRIPTE0006465_Hhex_2
  gRNA
uguugccauagcccacgggg

SEQ ID NO: 135687 - RNA, 20 nt, Artificial Sequence
  mmSKRIPTE0006466_Hhex_3
  gRNA
cggguguuaggccucgagug

SEQ ID NO: 135688 - RNA, 20 nt, Artificial Sequence
  mmSKRIPTE0006467_Hhex_4
  gRNA
caggccgagugugaaaucag

SEQ ID NO: 135689 - RNA, 20 nt, Artificial Sequence
  mmSKRIPTE0006468_Hhex_5
  gRNA
acacugcgaacgauccaaag

SEQ ID NO: 135690 - RNA, 20 nt, Artificial Sequence
  mmSKRIPTE0006469_Hhex_6
  gRNA
gcgguaguggcuuacaguag

SEQ ID NO: 135691 - RNA, 20 nt, Artificial Sequence
  mmSKRIPTE0006470_Hhex_7
  gRNA
cagaccaacuggaaaauucg

SEQ ID NO: 135692 - RNA, 20 nt, Artificial Sequence
  mmSKRIPTE0006471_Hhex_8
  gRNA
uaagugcaccucuaaagucg

SEQ ID NO: 135693 - RNA, 20 nt, Artificial Sequence
  mmSKRIPTE0006472_Hhex_9
  gRNA
gcauguaugugauaggaaca

SEQ ID NO: 135694 - RNA, 20 nt, Artificial Sequence
  mmSKRIPTE0006473_Ldb1_1
  gRNA
ccccacaucccgauccagca

SEQ ID NO: 135695 - RNA, 20 nt, Artificial Sequence
  mmSKRIPTE0006474_Ldb1_2
  gRNA
gagguccccaaacauaaucg

SEQ ID NO: 135696 - RNA, 20 nt, Artificial Sequence
  mmSKRIPTE0006475_Ldb1_3
  gRNA
aaaaugcuucggaaguagcg

SEQ ID NO: 135697 - RNA, 20 nt, Artificial Sequence
  mmSKRIPTE0006476_Ldb1_4
  gRNA
aucaucagagacuuacucgg

SEQ ID NO: 135698 - RNA, 20 nt, Artificial Sequence
  mmSKRIPTE0006477_Ldb1_5
  gRNA
accagacagugguaaacuag

SEQ ID NO: 135699 - RNA, 20 nt, Artificial Sequence
  mmSKRIPTE0006478_Ldb1_6
  gRNA
ucgccgaaggagcccccgaa

SEQ ID NO: 135700 - RNA, 20 nt, Artificial Sequence
  mmSKRIPTE0006479_Ldb1_7
  gRNA
cugguucaccauauaccucg

SEQ ID NO: 135701 - RNA, 20 nt, Artificial Sequence
  mmSKRIPTE0006480_Ldb1_8
  gRNA
cggcaaacccauguuuaccc

SEQ ID NO: 135702 - RNA, 20 nt, Artificial Sequence
  mmSKRIPTE0006481_Ldb1_9
  gRNA
gcgguuuccccaaggaggcg

SEQ ID NO: 135703 - RNA, 20 nt, Artificial Sequence
  mmSKRIPTE0006482_Il1f9_1
  gRNA
cggaagccaucauuacaccu

SEQ ID NO: 135704 - RNA, 20 nt, Artificial Sequence
  mmSKRIPTE0006483_Il1f9_2
  gRNA
gucucaguacauaugaacug

SEQ ID NO: 135705 - RNA, 20 nt, Artificial Sequence
  mmSKRIPTE0006484_Il1f9_3
  gRNA
ccaagcgcaauaacgaccag

SEQ ID NO: 135706 - RNA, 20 nt, Artificial Sequence
  mmSKRIPTE0006485_Il1f9_4
  gRNA
gcaccagaacaagaucacga

SEQ ID NO: 135707 - RNA, 20 nt, Artificial Sequence
  mmSKRIPTE0006486_Il1f9_5
  gRNA
gcuucguggaacugucacaa

SEQ ID NO: 135708 - RNA, 20 nt, Artificial Sequence
  mmSKRIPTE0006487_Il1f9_6
  gRNA
ggagcauauacugauuaccc

SEQ ID NO: 135709 - RNA, 20 nt, Artificial Sequence
  mmSKRIPTE0006488_Il1f9_7
  gRNA
caugguaugaaucaggccaa

SEQ ID NO: 135710 - RNA, 20 nt, Artificial Sequence
  mmSKRIPTE0006489_Il1f9_8
  gRNA
acucuggguacuugcauggg

SEQ ID NO: 135711 - RNA, 20 nt, Artificial Sequence
  mmSKRIPTE0006490_Il1f9_9
  gRNA
caaagucggugggauuggag

SEQ ID NO: 135712 - RNA, 20 nt, Artificial Sequence
  mmSKRIPTE0006491_Il1rn_1
  gRNA
caacccugaaagugucgcaa

SEQ ID NO: 135713 - RNA, 20 nt, Artificial Sequence
  mmSKRIPTE0006492_Il1rn_2
  gRNA
guuccucugcacaacacuag

SEQ ID NO: 135714 - RNA, 20 nt, Artificial Sequence
  mmSKRIPTE0006493_Il1rn_3
  gRNA
agcuuugggaucgagcaaag

SEQ ID NO: 135715 - RNA, 20 nt, Artificial Sequence
  mmSKRIPTE0006494_Il1rn_4
  gRNA
acuuggaagauaucucucgu

SEQ ID NO: 135716 - RNA, 20 nt, Artificial Sequence
  mmSKRIPTE0006495_Il1rn_5
  gRNA
aaauggucagguaauugccg

SEQ ID NO: 135717 - RNA, 20 nt, Artificial Sequence
  mmSKRIPTE0006496_Il1rn_6
  gRNA
guguucuugggcauccacgg

SEQ ID NO: 135718 - RNA, 20 nt, Artificial Sequence
  mmSKRIPTE0006497_Il1rn_7
  gRNA
uagaaggugaguggauaaca

SEQ ID NO: 135719 - RNA, 20 nt, Artificial Sequence
  mmSKRIPTE0006498_Il1rn_8
  gRNA
uuguugauaacucuuaccaa

SEQ ID NO: 135720 - RNA, 20 nt, Artificial Sequence
  mmSKRIPTE0006499_Il1rn_9
  gRNA
gcuguucaaacauuaucuug

SEQ ID NO: 135721 - RNA, 20 nt, Artificial Sequence
  mmSKRIPTE0006500_Iugav_1
  gRNA
gcggggcgagcacaguaccu

SEQ ID NO: 135722 - RNA, 20 nt, Artificial Sequence
  mmSKRIPTE0006501_Iugav_2
  gRNA
guugaaaaccugacacggug

SEQ ID NO: 135723 - RNA, 20 nt, Artificial Sequence
  mmSKRIPTE0006502_Iugav_3
  gRNA
gacuuccucuuucggcgggg

SEQ ID NO: 135724 - RNA, 20 nt, Artificial Sequence
  mmSKRIPTE0006503_Iugav_4
  gRNA
ucucaacaggaagaucuacg

SEQ ID NO: 135725 - RNA, 20 nt, Artificial Sequence
  mmSKRIPTE0006504_Iugav_5
  gRNA
cuguagugagucuaaccccg

SEQ ID NO: 135726 - RNA, 20 nt, Artificial Sequence
  mmSKRIPTE0006505_Iugav_6
  gRNA
guauuagcuucaauaagcug

SEQ ID NO: 135727 - RNA, 20 nt, Artificial Sequence
  mmSKRIPTE0006506_Iugav_7
  gRNA
gaccauauuagccugcuaug

SEQ ID NO: 135728 - RNA, 20 nt, Artificial Sequence
  mmSKRIPTE0006507_Iugav_8
  gRNA
acaugugaggaauauuaacg

SEQ ID NO: 135729 - RNA, 20 nt, Artificial Sequence
  mmSKRIPTE0006508_Iugav_9
  gRNA
ucauggaccgagguuccgau

SEQ ID NO: 135730 - RNA, 20 nt, Artificial Sequence
  mmSKRIPTE0006509_Rbck1_1
  gRNA
gagggcccugucuaugaacg

SEQ ID NO: 135731 - RNA, 20 nt, Artificial Sequence
  mmSKRIPTE0006510_Rbck1_2
  gRNA
uauugugcaucaccgcagca

SEQ ID NO: 135732 - RNA, 20 nt, Artificial Sequence
  mmSKRIPTE0006511_Rbck1_3
  gRNA
gcccaucuaaaggugcagug

SEQ ID NO: 135733 - RNA, 20 nt, Artificial Sequence
  mmSKRIPTE0006512_Rbck1_4
  gRNA
agggucgggugucuagugca

SEQ ID NO: 135734 - RNA, 20 nt, Artificial Sequence
  mmSKRIPTE0006513_Rbck1_5
  gRNA
guccagaguaggaccgagag

SEQ ID NO: 135735 - RNA, 20 nt, Artificial Sequence
  mmSKRIPTE0006514_Rbck1_6
  gRNA
gcucgggaaagccgacgcag

SEQ ID NO: 135736 - RNA, 20 nt, Artificial Sequence
  mmSKRIPTE0006515_Rbck1_7
  gRNA
gggagcccucuguaacgaag

SEQ ID NO: 135737 - RNA, 20 nt, Artificial Sequence
  mmSKRIPTE0006516_Rbck1_8
  gRNA
aacugccacuaagucgacga

SEQ ID NO: 135738 - RNA, 20 nt, Artificial Sequence
  mmSKRIPTE0006517_Rbck1_9
  gRNA
agaccguggaacuguugcug

SEQ ID NO: 135739 - RNA, 20 nt, Artificial Sequence
  mmSKRIPTE0006518_L3mbtl1_1
  gRNA
gagugacuaugguuggucag

SEQ ID NO: 135740 - RNA, 20 nt, Artificial Sequence
  mmSKRIPTE0006519_L3mbtl1_2
  gRNA
agagagugggcgaucagcgu

SEQ ID NO: 135741 - RNA, 20 nt, Artificial Sequence
  mmSKRIPTE0006520_L3mbtl1_3
  gRNA
ccuagaguucaguugccccg

SEQ ID NO: 135742 - RNA, 20 nt, Artificial Sequence
  mmSKRIPTE0006521_L3mbtl1_4
  gRNA
agcgcgccucuucaaagacg

SEQ ID NO: 135743 - RNA, 20 nt, Artificial Sequence
  mmSKRIPTE0006522_L3mbtl1_5
  gRNA
gcauuuaccaaagccccccg

SEQ ID NO: 135744 - RNA, 20 nt, Artificial Sequence
  mmSKRIPTE0006523_L3mbtl1_6
  gRNA
gugcacguugaccuccccug

SEQ ID NO: 135745 - RNA, 20 nt, Artificial Sequence
  mmSKRIPTE0006524_L3mbtl1_7
  gRNA
guugggcucgccacccgaug

SEQ ID NO: 135746 - RNA, 20 nt, Artificial Sequence
  mmSKRIPTE0006525_L3mbtl1_8
  gRNA
cucgccgucaaucaucugag

SEQ ID NO: 135747 - RNA, 20 nt, Artificial Sequence
  mmSKRIPTE0006526_L3mbtl1_9
  gRNA
gugguaaaaugagggccgcg

SEQ ID NO: 135748 - RNA, 20 nt, Artificial Sequence
  mmSKRIPTE0006527_Dtx1_1
  gRNA
ugccauucaaguucuucacg

SEQ ID NO: 135749 - RNA, 20 nt, Artificial Sequence
  mmSKRIPTE0006528_Dtx1_2
  gRNA
guggccauccagacgcugcg

SEQ ID NO: 135750 - RNA, 20 nt, Artificial Sequence
  mmSKRIPTE0006529_Dtx1_3
  gRNA
ucagaccacugacggaaucg

SEQ ID NO: 135751 - RNA, 20 nt, Artificial Sequence
  mmSKRIPTE0006530_Dtx1_4
  gRNA
ugggucucaaauguccggag

SEQ ID NO: 135752 - RNA, 20 nt, Artificial Sequence
  mmSKRIPTE0006531_Dtx1_5
  gRNA
ucagucgaccaggaccacag

SEQ ID NO: 135753 - RNA, 20 nt, Artificial Sequence
  mmSKRIPTE0006532_Dtx1_6
  gRNA
gacgcaguaguccuggcgcg

SEQ ID NO: 135754 - RNA, 20 nt, Artificial Sequence
  mmSKRIPTE0006533_Dtx1_7
  gRNA
gucguuauguccccgcccgg

SEQ ID NO: 135755 - RNA, 20 nt, Artificial Sequence
  mmSKRIPTE0006534_Dtx1_8
  gRNA
ccugagacacuuagaccgag

SEQ ID NO: 135756 - RNA, 20 nt, Artificial Sequence
  mmSKRIPTE0006535_Dtx1_9
  gRNA
aaccugcaaagccaucuacg

SEQ ID NO: 135757 - RNA, 20 nt, Artificial Sequence
  mmSKRIPTE0006536_Ppp4r2_1
  gRNA
cuguuuauacagauacacgu

SEQ ID NO: 135758 - RNA, 20 nt, Artificial Sequence
  mmSKRIPTE0006537_Ppp4r2_2
  gRNA
guccaaauucgagaccccug

SEQ ID NO: 135759 - RNA, 20 nt, Artificial Sequence
  mmSKRIPTE0006538_Ppp4r2_3
  gRNA
guaauauucaucaccgugug

SEQ ID NO: 135760 - RNA, 20 nt, Artificial Sequence
  mmSKRIPTE0006539_Ppp4r2_4
  gRNA
gcggcuaugugaauugcuaa

SEQ ID NO: 135761 - RNA, 20 nt, Artificial Sequence
  mmSKRIPTE0006540_Ppp4r2_5
  gRNA
cggcgacagcuacagcaggg

SEQ ID NO: 135762 - RNA, 20 nt, Artificial Sequence
  mmSKRIPTE0006541_Ppp4r2_6
  gRNA
uccauauaagcauuauagca

SEQ ID NO: 135763 - RNA, 20 nt, Artificial Sequence
  mmSKRIPTE0006542_Ppp4r2_7
  gRNA
gugcauuguaaacaucacug

SEQ ID NO: 135764 - RNA, 20 nt, Artificial Sequence
  mmSKRIPTE0006543_Ppp4r2_8
  gRNA
uacaauauaccgcuucacaa

SEQ ID NO: 135765 - RNA, 20 nt, Artificial Sequence
  mmSKRIPTE0006544_Ppp4r2_9
  gRNA
gcgcgaggacgacagcugug

SEQ ID NO: 135766 - RNA, 20 nt, Artificial Sequence
  mmSKRIPTE0006545_Pparg_1
  gRNA
gcacccuugaaaaauucgga

SEQ ID NO: 135767 - RNA, 20 nt, Artificial Sequence
  mmSKRIPTE0006546_Pparg_2
  gRNA
gaacacgagucacaguacca

SEQ ID NO: 135768 - RNA, 20 nt, Artificial Sequence
  mmSKRIPTE0006547_Pparg_3
  gRNA
ggaacacguugucagcgggu

SEQ ID NO: 135769 - RNA, 20 nt, Artificial Sequence
  mmSKRIPTE0006548_Pparg_4
  gRNA
uuaagcagguucguggagcg

SEQ ID NO: 135770 - RNA, 20 nt, Artificial Sequence
  mmSKRIPTE0006549_Pparg_5
  gRNA
agucaccaaagggcuuccgc

SEQ ID NO: 135771 - RNA, 20 nt, Artificial Sequence
  mmSKRIPTE0006550_Pparg_6
  gRNA
aucuagaacuucaagcguag

SEQ ID NO: 135772 - RNA, 20 nt, Artificial Sequence
  mmSKRIPTE0006551_Pparg_7
  gRNA
ucugucuguucagcagaaug

SEQ ID NO: 135773 - RNA, 20 nt, Artificial Sequence
  mmSKRIPTE0006552_Pparg_8
  gRNA
aaggcagaaccagcgccggg

SEQ ID NO: 135774 - RNA, 20 nt, Artificial Sequence
  mmSKRIPTE0006553_Pparg_9
  gRNA
uggcauccgcccaaaccuga

SEQ ID NO: 135775 - RNA, 20 nt, Artificial Sequence
  mmSKRIPTE0006554_Cd177_1
  gRNA
auguccgguucacucucgca

SEQ ID NO: 135776 - RNA, 20 nt, Artificial Sequence
  mmSKRIPTE0006555_Cd177_2
  gRNA
gcucauagacguagguacgu

SEQ ID NO: 135777 - RNA, 20 nt, Artificial Sequence
  mmSKRIPTE0006556_Cd177_3
  gRNA
uggaucccauaccuggacga

SEQ ID NO: 135778 - RNA, 20 nt, Artificial Sequence
  mmSKRIPTE0006557_Cd177_4
  gRNA
uggaggcgacagauucggug

SEQ ID NO: 135779 - RNA, 20 nt, Artificial Sequence
  mmSKRIPTE0006558_Cd177_5
  gRNA
gaaaggcugcacuaccgcaa

SEQ ID NO: 135780 - RNA, 20 nt, Artificial Sequence
  mmSKRIPTE0006559_Cd177_6
  gRNA
auggcgacacacacgggugu

SEQ ID NO: 135781 - RNA, 20 nt, Artificial Sequence
  mmSKRIPTE0006560_Cd177_7
  gRNA
auacaaggucccaaucgccu

SEQ ID NO: 135782 - RNA, 20 nt, Artificial Sequence
  mmSKRIPTE0006561_Cd177_8
  gRNA
acaugcaacucaccugacgg

SEQ ID NO: 135783 - RNA, 20 nt, Artificial Sequence
  mmSKRIPTE0006562_Cd177_9
  gRNA
ugucaaagaguaaccccacg

SEQ ID NO: 135784 - RNA, 20 nt, Artificial Sequence
  mmSKRIPTE0006563_Pycard_1
  gRNA
uagccuugaacuuagcaccg

SEQ ID NO: 135785 - RNA, 20 nt, Artificial Sequence
  mmSKRIPTE0006564_Pycard_2
  gRNA
ggucaagcuaaaaagcgaga

SEQ ID NO: 135786 - RNA, 20 nt, Artificial Sequence
  mmSKRIPTE0006565_Pycard_3
  gRNA
cuaugggcgcaucccacgcg

SEQ ID NO: 135787 - RNA, 20 nt, Artificial Sequence
  mmSKRIPTE0006566_Pycard_4
  gRNA
ucuguugauaaagauccacc

SEQ ID NO: 135788 - RNA, 20 nt, Artificial Sequence
  mmSKRIPTE0006567_Pycard_5
  gRNA
guugaggguagacgaacaag

SEQ ID NO: 135789 - RNA, 20 nt, Artificial Sequence
  mmSKRIPTE0006568_Pycard_6
  gRNA
ggaacaguuaagcgccaaag

SEQ ID NO: 135790 - RNA, 20 nt, Artificial Sequence
  mmSKRIPTE0006569_Pycard_7
  gRNA
gcaagaguaaaaggugaccg

SEQ ID NO: 135791 - RNA, 20 nt, Artificial Sequence
  mmSKRIPTE0006570_Pycard_8
  gRNA
ugggaacuccugucuagaca

SEQ ID NO: 135792 - RNA, 20 nt, Artificial Sequence
  mmSKRIPTE0006571_Pycard_9
  gRNA
gcuaggcugaagaaacuagg

SEQ ID NO: 135793 - RNA, 20 nt, Artificial Sequence
  mmSKRIPTE0006572_Klf1_1
  gRNA
gcucgcgagucggaguacga

SEQ ID NO: 135794 - RNA, 20 nt, Artificial Sequence
  mmSKRIPTE0006573_Klf1_2
  gRNA
agaccgccaccacugcggga

SEQ ID NO: 135795 - RNA, 20 nt, Artificial Sequence
  mmSKRIPTE0006574_Klf1_3
  gRNA
cgacaacaauccuagcagau

SEQ ID NO: 135796 - RNA, 20 nt, Artificial Sequence
  mmSKRIPTE0006575_Klf1_4
  gRNA
ccccucccuucguucacuag

SEQ ID NO: 135797 - RNA, 20 nt, Artificial Sequence
  mmSKRIPTE0006576_Klf1_5
  gRNA
aggcaggcggcacauacgug

SEQ ID NO: 135798 - RNA, 20 nt, Artificial Sequence
  mmSKRIPTE0006577_Klf1_6
  gRNA
uuugggcggcgcaguucccg

SEQ ID NO: 135799 - RNA, 20 nt, Artificial Sequence
  mmSKRIPTE0006578_Klf1_7
  gRNA
aagggguuaggggaaccgug

SEQ ID NO: 135800 - RNA, 20 nt, Artificial Sequence
  mmSKRIPTE0006579_Klf1_8
  gRNA
ccagcucuuucgcgggcucg

SEQ ID NO: 135801 - RNA, 20 nt, Artificial Sequence
  mmSKRIPTE0006580_Klf1_9
  gRNA
ucacgugagucugaaaucgg

SEQ ID NO: 135802 - RNA, 20 nt, Artificial Sequence
  mmSKRIPTE0006581_Zbtb16_1
  gRNA
uguguagacgcccguccaug

SEQ ID NO: 135803 - RNA, 20 nt, Artificial Sequence
  mmSKRIPTE0006582_Zbtb16_2
  gRNA
gugcucauauguaugcggac

SEQ ID NO: 135804 - RNA, 20 nt, Artificial Sequence
  mmSKRIPTE0006583_Zbtb16_3
  gRNA
uauagcugcgcacgccugcg

SEQ ID NO: 135805 - RNA, 20 nt, Artificial Sequence
  mmSKRIPTE0006584_Zbtb16_4
  gRNA
auggacuucagcaccuacgg

SEQ ID NO: 135806 - RNA, 20 nt, Artificial Sequence
  mmSKRIPTE0006585_Zbtb16_5
  gRNA
gaugguacacugguauggcg

SEQ ID NO: 135807 - RNA, 20 nt, Artificial Sequence
  mmSKRIPTE0006586_Zbtb16_6
  gRNA
gugggcuggaccaucgaaca

SEQ ID NO: 135808 - RNA, 20 nt, Artificial Sequence
  mmSKRIPTE0006587_Zbtb16_7
  gRNA
acgcacuacaggguucacac

SEQ ID NO: 135809 - RNA, 20 nt, Artificial Sequence
  mmSKRIPTE0006588_Zbtb16_8
  gRNA
augccgucuucagugacguc

SEQ ID NO: 135810 - RNA, 20 nt, Artificial Sequence
  mmSKRIPTE0006589_Zbtb16_9
  gRNA
agaaccccgcacgagcccag

SEQ ID NO: 135811 - RNA, 20 nt, Artificial Sequence
  mmSKRIPTE0006590_Sirt1_1
  gRNA
guuaggaccauuacugccag

SEQ ID NO: 135812 - RNA, 20 nt, Artificial Sequence
  mmSKRIPTE0006591_Sirt1_2
  gRNA
gcuuggaagaugauacggag

SEQ ID NO: 135813 - RNA, 20 nt, Artificial Sequence
  mmSKRIPTE0006592_Sirt1_3
  gRNA
gccugaagcauaccuauccg

SEQ ID NO: 135814 - RNA, 20 nt, Artificial Sequence
  mmSKRIPTE0006593_Sirt1_4
  gRNA
gacgucacaguggcucucgu

SEQ ID NO: 135815 - RNA, 20 nt, Artificial Sequence
  mmSKRIPTE0006594_Sirt1_5
  gRNA
cgguaucuaugcucgccuug

SEQ ID NO: 135816 - RNA, 20 nt, Artificial Sequence
  mmSKRIPTE0006595_Sirt1_6
  gRNA
aaugugccgagugcuaaccu

SEQ ID NO: 135817 - RNA, 20 nt, Artificial Sequence
  mmSKRIPTE0006596_Sirt1_7
  gRNA
aagguucuaugacuacuaug

SEQ ID NO: 135818 - RNA, 20 nt, Artificial Sequence
  mmSKRIPTE0006597_Sirt1_8
  gRNA
gcucuagugacuggacuccg

SEQ ID NO: 135819 - RNA, 20 nt, Artificial Sequence
  mmSKRIPTE0006598_Sirt1_9
  gRNA
cugaguauaccucagcaccg

SEQ ID NO: 135820 - RNA, 20 nt, Artificial Sequence
  mmSKRIPTE0006599_Iugb2_1
  gRNA
aucuccgugaguuucugucg

SEQ ID NO: 135821 - RNA, 20 nt, Artificial Sequence
  mmSKRIPTE0006600_Iugb2_2
  gRNA
cacuuuacuugcgaccaggu

SEQ ID NO: 135822 - RNA, 20 nt, Artificial Sequence
  mmSKRIPTE0006601_Iugb2_3
  gRNA
aauguagccagacucacacc

SEQ ID NO: 135823 - RNA, 20 nt, Artificial Sequence
  mmSKRIPTE0006602_Iugb2_4
  gRNA
aaguugcugcauguccggug

SEQ ID NO: 135824 - RNA, 20 nt, Artificial Sequence
  mmSKRIPTE0006603_Iugb2_5
  gRNA
cuaacgucccacguguaaag

SEQ ID NO: 135825 - RNA, 20 nt, Artificial Sequence
  mmSKRIPTE0006604_Iugb2_6
  gRNA
gcagugggaacacucacgug

SEQ ID NO: 135826 - RNA, 20 nt, Artificial Sequence
  mmSKRIPTE0006605_Iugb2_7
  gRNA
uuggcuggcgcaaugucacg

SEQ ID NO: 135827 - RNA, 20 nt, Artificial Sequence
  mmSKRIPTE0006606_Iugb2_8
  gRNA
cuccagucagauucucggag

SEQ ID NO: 135828 - RNA, 20 nt, Artificial Sequence
  mmSKRIPTE0006607_Iugb2_9
  gRNA
ccuguucuaagucagcgccc

SEQ ID NO: 135829 - RNA, 20 nt, Artificial Sequence
  mmSKRIPTE0006608_Bdkrb2_1
  gRNA
uuugagaaccucgaucuccg

SEQ ID NO: 135830 - RNA, 20 nt, Artificial Sequence
  mmSKRIPTE0006609_Bdkrb2_2
  gRNA
ucccguuaagagcagacccg

SEQ ID NO: 135831 - RNA, 20 nt, Artificial Sequence
  mmSKRIPTE0006610_Bdkrb2_3
  gRNA
agauccccugacuuacccaa

SEQ ID NO: 135832 - RNA, 20 nt, Artificial Sequence
  mmSKRIPTE0006611_Bdkrb2_4
  gRNA
gaaaaggugaguuuccggca

SEQ ID NO: 135833 - RNA, 20 nt, Artificial Sequence
  mmSKRIPTE0006612_Bdkrb2_5
  gRNA
ggcccagaaagguaacccgc

SEQ ID NO: 135834 - RNA, 20 nt, Artificial Sequence
  mmSKRIPTE0006613_Bdkrb2_6
  gRNA
gacggccagcacuagcacgg

SEQ ID NO: 135835 - RNA, 20 nt, Artificial Sequence
  mmSKRIPTE0006614_Bdkrb2_7
  gRNA
gaugacucccggcggcagug

SEQ ID NO: 135836 - RNA, 20 nt, Artificial Sequence
  mmSKRIPTE0006615_Bdkrb2_8
  gRNA
ccacugguguacgugaucgu

SEQ ID NO: 135837 - RNA, 20 nt, Artificial Sequence
  mmSKRIPTE0006616_Bdkrb2_9
  gRNA
uaggucugagaaaugaagcg

SEQ ID NO: 135838 - RNA, 20 nt, Artificial Sequence
  mmSKRIPTE0006617_Trim38_1
  gRNA
acgauauuacgacgucacca

SEQ ID NO: 135839 - RNA, 20 nt, Artificial Sequence
  mmSKRIPTE0006618_Trim38_2
  gRNA
gagguguacaucuaccacug

SEQ ID NO: 135840 - RNA, 20 nt, Artificial Sequence
  mmSKRIPTE0006619_Trim38_3
  gRNA
auuagauuggacacuuguag

SEQ ID NO: 135841 - RNA, 20 nt, Artificial Sequence
  mmSKRIPTE0006620_Trim38_4
  gRNA
ucugcgaagcuuugacacca

SEQ ID NO: 135842 - RNA, 20 nt, Artificial Sequence
  mmSKRIPTE0006621_Trim38_5
  gRNA
gcaucaggaugaucuccacu

SEQ ID NO: 135843 - RNA, 20 nt, Artificial Sequence
  mmSKRIPTE0006622_Trim38_6
  gRNA
cagcuggaagaaccuuaagc

SEQ ID NO: 135844 - RNA, 20 nt, Artificial Sequence
  mmSKRIPTE0006623_Trim38_7
  gRNA
gacuuacaaaagaugcccca

SEQ ID NO: 135845 - RNA, 20 nt, Artificial Sequence
  mmSKRIPTE0006624_Trim38_8
  gRNA
cccagaaauugcuacaggug

SEQ ID NO: 135846 - RNA, 20 nt, Artificial Sequence
  mmSKRIPTE0006625_Trim38_9
  gRNA
ggucuguauguagagccgac

SEQ ID NO: 135847 - RNA, 20 nt, Artificial Sequence
  mmSKRIPTE0006626_Srf_1
  gRNA
ggcugacgggcaagucagcg

SEQ ID NO: 135848 - RNA, 20 nt, Artificial Sequence
  mmSKRIPTE0006627_Srf_2
  gRNA
cgucccccuagauaagcggg

SEQ ID NO: 135849 - RNA, 20 nt, Artificial Sequence
  mmSKRIPTE0006628_Srf_3
  gRNA
accugaaccggaccccgacg

SEQ ID NO: 135850 - RNA, 20 nt, Artificial Sequence
  mmSKRIPTE0006629_Srf_4
  gRNA
gucagauuccgacaccuggu

SEQ ID NO: 135851 - RNA, 20 nt, Artificial Sequence
  mmSKRIPTE0006630_Srf_5
  gRNA
gagugcgugugguauauccg

SEQ ID NO: 135852 - RNA, 20 nt, Artificial Sequence
  mmSKRIPTE0006631_Srf_6
  gRNA
cugggcgaggacuuaaugca

SEQ ID NO: 135853 - RNA, 20 nt, Artificial Sequence
  mmSKRIPTE0006632_Srf_7
  gRNA
ccccugggcaaguacuagaa

SEQ ID NO: 135854 - RNA, 20 nt, Artificial Sequence
  mmSKRIPTE0006633_Srf_8
  gRNA
ugaguauuagcugacccgau

SEQ ID NO: 135855 - RNA, 20 nt, Artificial Sequence
  mmSKRIPTE0006634_Srf_9
  gRNA
cacacacacugacuggccga

SEQ ID NO: 135856 - RNA, 20 nt, Artificial Sequence
  mmSKRIPTE0006635_Tmem173_1
  gRNA
uucaguuccaaacgacacug

SEQ ID NO: 135857 - RNA, 20 nt, Artificial Sequence
  mmSKRIPTE0006636_Tmem173_2
  gRNA
ugcuggguaucaagucaucg

SEQ ID NO: 135858 - RNA, 20 nt, Artificial Sequence
  mmSKRIPTE0006637_Tmem173_3
  gRNA
cuacagcaccugucuaggag

SEQ ID NO: 135859 - RNA, 20 nt, Artificial Sequence
  mmSKRIPTE0006638_Tmem173_4
  gRNA
gaaaggccaaguacuucccg

SEQ ID NO: 135860 - RNA, 20 nt, Artificial Sequence
  mmSKRIPTE0006639_Tmem173_5
  gRNA
uuaauaguuucagccuuccg

SEQ ID NO: 135861 - RNA, 20 nt, Artificial Sequence
  mmSKRIPTE0006640_Tmem173_6
  gRNA
ugaucccccggaaaucggga

SEQ ID NO: 135862 - RNA, 20 nt, Artificial Sequence
  mmSKRIPTE0006641_Tmem173_7
  gRNA
gcuaggacaugauagcuaug

SEQ ID NO: 135863 - RNA, 20 nt, Artificial Sequence
  mmSKRIPTE0006642_Tmem173_8
  gRNA
ugccgccucauugucuacca

SEQ ID NO: 135864 - RNA, 20 nt, Artificial Sequence
  mmSKRIPTE0006643_Tmem173_9
  gRNA
guaugaccaggccagcccgu

SEQ ID NO: 135865 - RNA, 20 nt, Artificial Sequence
  mmSKRIPTE0006644_Cdkn2a_1
  gRNA
ccucgaguucgcuuuccucg

SEQ ID NO: 135866 - RNA, 20 nt, Artificial Sequence
  mmSKRIPTE0006645_Cdkn2a_2
  gRNA
cacaagcggcuaucgcgugg

SEQ ID NO: 135867 - RNA, 20 nt, Artificial Sequence
  mmSKRIPTE0006646_Cdkn2a_3
  gRNA
cggugcagauucgaacugcg

SEQ ID NO: 135868 - RNA, 20 nt, Artificial Sequence
  mmSKRIPTE0006647_Cdkn2a_4
  gRNA
gguacgaccgaaagaguucg

SEQ ID NO: 135869 - RNA, 20 nt, Artificial Sequence
  mmSKRIPTE0006648_Cdkn2a_5
  gRNA
cgggacuaggagccuuuaug

SEQ ID NO: 135870 - RNA, 20 nt, Artificial Sequence
  mmSKRIPTE0006649_Cdkn2a_6
  gRNA
augcuagcgugucuagcaug

SEQ ID NO: 135871 - RNA, 20 nt, Artificial Sequence
  mmSKRIPTE0006650_Cdkn2a_7
  gRNA
uugaccaggagccagcgggu

SEQ ID NO: 135872 - RNA, 20 nt, Artificial Sequence
  mmSKRIPTE0006651_Cdkn2a_8
  gRNA
aagcuccgcuguuaacuacu

SEQ ID NO: 135873 - RNA, 20 nt, Artificial Sequence
  mmSKRIPTE0006652_Cdkn2a_9
  gRNA
ggaacgucgcccagaccgac

SEQ ID NO: 135874 - RNA, 20 nt, Artificial Sequence
  mmSKRIPTE0006653_Tnfsf4_1
  gRNA
uuggaaagaagauuaccccg

SEQ ID NO: 135875 - RNA, 20 nt, Artificial Sequence
  mmSKRIPTE0006654_Tnfsf4_2
  gRNA
acuggugcaucuuaccggag

SEQ ID NO: 135876 - RNA, 20 nt, Artificial Sequence
  mmSKRIPTE0006655_Tnfsf4_3
  gRNA
ucuauuccaaugcugaacga

SEQ ID NO: 135877 - RNA, 20 nt, Artificial Sequence
  mmSKRIPTE0006656_Tnfsf4_4
  gRNA
acaacucccuguuagcccgg

SEQ ID NO: 135878 - RNA, 20 nt, Artificial Sequence
  mmSKRIPTE0006657_Tnfsf4_5
  gRNA
uucaaguccugcuuuccacg

SEQ ID NO: 135879 - RNA, 20 nt, Artificial Sequence
  mmSKRIPTE0006658_Tnfsf4_6
  gRNA
gaggagauacagcuguggcg

SEQ ID NO: 135880 - RNA, 20 nt, Artificial Sequence
  mmSKRIPTE0006659_Tnfsf4_7
  gRNA
gaaaagcuacgucuuucacc

SEQ ID NO: 135881 - RNA, 20 nt, Artificial Sequence
  mmSKRIPTE0006660_Tnfsf4_8
  gRNA
gauugaccuucauuuccggg

SEQ ID NO: 135882 - RNA, 20 nt, Artificial Sequence
  mmSKRIPTE0006661_Tnfsf4_9
  gRNA
ccucagaguggaauucacag

SEQ ID NO: 135883 - RNA, 20 nt, Artificial Sequence
  mmSKRIPTE0006662_Fcgr2b_1
  gRNA
cggugacacugacaugcgaa

SEQ ID NO: 135884 - RNA, 20 nt, Artificial Sequence
  mmSKRIPTE0006663_Fcgr2b_2
  gRNA
gugggaugcgauaugcuaag

SEQ ID NO: 135885 - RNA, 20 nt, Artificial Sequence
  mmSKRIPTE0006664_Fcgr2b_3
  gRNA
ugauuccggaucgaggaaga

SEQ ID NO: 135886 - RNA, 20 nt, Artificial Sequence
  mmSKRIPTE0006665_Fcgr2b_4
  gRNA
acggguagacagcgaugaug

SEQ ID NO: 135887 - RNA, 20 nt, Artificial Sequence
  mmSKRIPTE0006666_Fcgr2b_5
  gRNA
cccauagugacuaacccaag

SEQ ID NO: 135888 - RNA, 20 nt, Artificial Sequence
  mmSKRIPTE0006667_Fcgr2b_6
  gRNA
acuacgagauugguucccaa

SEQ ID NO: 135889 - RNA, 20 nt, Artificial Sequence
  mmSKRIPTE0006668_Fcgr2b_7
  gRNA
gccagucugaaagacacgaa

SEQ ID NO: 135890 - RNA, 20 nt, Artificial Sequence
  mmSKRIPTE0006669_Fcgr2b_8
  gRNA
augccaagggagacuaaaug

SEQ ID NO: 135891 - RNA, 20 nt, Artificial Sequence
  mmSKRIPTE0006670_Fcgr2b_9
  gRNA
aggucccgacuuacuuagca

SEQ ID NO: 135892 - RNA, 20 nt, Artificial Sequence
  mmSKRIPTE0006671_Tlr5_1
  gRNA
gggcugccuugcaugacgaa

SEQ ID NO: 135893 - RNA, 20 nt, Artificial Sequence
  mmSKRIPTE0006672_Tlr5_2
  gRNA
ccucaagagcauucucaucg

SEQ ID NO: 135894 - RNA, 20 nt, Artificial Sequence
  mmSKRIPTE0006673_Tlr5_3
  gRNA
aggcuauuuaucacccacgc

SEQ ID NO: 135895 - RNA, 20 nt, Artificial Sequence
  mmSKRIPTE0006674_Tlr5_4
  gRNA
cugcaacuggaccuuucgca

SEQ ID NO: 135896 - RNA, 20 nt, Artificial Sequence
  mmSKRIPTE0006675_Tlr5_5
  gRNA
uugaaaucucacagcccggu

SEQ ID NO: 135897 - RNA, 20 nt, Artificial Sequence
  mmSKRIPTE0006676_Tlr5_6
  gRNA
aaggacccccagcggcugug

SEQ ID NO: 135898 - RNA, 20 nt, Artificial Sequence
  mmSKRIPTE0006677_Tlr5_7
  gRNA
aguugaaagucauaaagacg

SEQ ID NO: 135899 - RNA, 20 nt, Artificial Sequence
  mmSKRIPTE0006678_Tlr5_8
  gRNA
ccgagccucaggcugugaug

SEQ ID NO: 135900 - RNA, 20 nt, Artificial Sequence
  mmSKRIPTE0006679_Tlr5_9
  gRNA
uacacccaccugcugaagug

SEQ ID NO: 135901 - RNA, 20 nt, Artificial Sequence
  mmSKRIPTE0006680_Pik3r6_1
  gRNA
aacuccaagcgggagacacg

SEQ ID NO: 135902 - RNA, 20 nt, Artificial Sequence
  mmSKRIPTE0006681_Pik3r6_2
  gRNA
aauguucccaggacuccucg

SEQ ID NO: 135903 - RNA, 20 nt, Artificial Sequence
  mmSKRIPTE0006682_Pik3r6_3
  gRNA
ggcccugcccaauuuagcau

SEQ ID NO: 135904 - RNA, 20 nt, Artificial Sequence
  mmSKRIPTE0006683_Pik3r6_4
  gRNA
ggccagacuugaucaucaca

SEQ ID NO: 135905 - RNA, 20 nt, Artificial Sequence
  mmSKRIPTE0006684_Pik3r6_5
  gRNA
ggguuguagacagagccaaa

SEQ ID NO: 135906 - RNA, 20 nt, Artificial Sequence
  mmSKRIPTE0006685_Pik3r6_6
  gRNA
ccaaggcgacuguagaguag

SEQ ID NO: 135907 - RNA, 20 nt, Artificial Sequence
  mmSKRIPTE0006686_Pik3r6_7
  gRNA
acuauuuguacagcgcccug

SEQ ID NO: 135908 - RNA, 20 nt, Artificial Sequence
  mmSKRIPTE0006687_Pik3r6_8
  gRNA
accaugggucgacucgaccc

SEQ ID NO: 135909 - RNA, 20 nt, Artificial Sequence
  mmSKRIPTE0006688_Pik3r6_9
  gRNA
cuauggcagccacaacggcg

SEQ ID NO: 135910 - RNA, 20 nt, Artificial Sequence
  mmSKRIPTE0006689_Tnfsf12_1
  gRNA
cggagugaaccagcccacgu

SEQ ID NO: 135911 - RNA, 20 nt, Artificial Sequence
  mmSKRIPTE0006690_Tnfsf12_2
  gRNA
aaaagcgcucuauacaugug

SEQ ID NO: 135912 - RNA, 20 nt, Artificial Sequence
  mmSKRIPTE0006691_Tnfsf12_3
  gRNA
caagagucugaugaggcgga

SEQ ID NO: 135913 - RNA, 20 nt, Artificial Sequence
  mmSKRIPTE0006692_Tnfsf12_4
  gRNA
agucuauagagacugcgagg

SEQ ID NO: 135914 - RNA, 20 nt, Artificial Sequence
  mmSKRIPTE0006693_Tnfsf12_5
  gRNA
accuggcacaaacggagcug

SEQ ID NO: 135915 - RNA, 20 nt, Artificial Sequence
  mmSKRIPTE0006694_Tnfsf12_6
  gRNA
cuucguguaccauaagggca

SEQ ID NO: 135916 - RNA, 20 nt, Artificial Sequence
  mmSKRIPTE0006695_Tnfsf12_7
  gRNA
ugggcugcaauagcucggcg

SEQ ID NO: 135917 - RNA, 20 nt, Artificial Sequence
  mmSKRIPTE0006696_Tnfsf12_8
  gRNA
ugcuuaaggauucaccacag

SEQ ID NO: 135918 - RNA, 20 nt, Artificial Sequence
  mmSKRIPTE0006697_Tnfsf12_9
  gRNA
gaagagcaaggauacgucug

SEQ ID NO: 135919 - RNA, 20 nt, Artificial Sequence
  mmSKRIPTE0006698_Cebpe_1
  gRNA
uagggcaaaucuaggaccgg

SEQ ID NO: 135920 - RNA, 20 nt, Artificial Sequence
  mmSKRIPTE0006699_Cebpe_2
  gRNA
cccagggagcuacgacccca

SEQ ID NO: 135921 - RNA, 20 nt, Artificial Sequence
  mmSKRIPTE0006700_Cebpe_3
  gRNA
cuccgucaccaacuccuacg

SEQ ID NO: 135922 - RNA, 20 nt, Artificial Sequence
  mmSKRIPTE0006701_Cebpe_4
  gRNA
ugugccacuugguacugcag

SEQ ID NO: 135923 - RNA, 20 nt, Artificial Sequence
  mmSKRIPTE0006702_Cebpe_5
  gRNA
acgugaacguaacaacaucg

SEQ ID NO: 135924 - RNA, 20 nt, Artificial Sequence
  mmSKRIPTE0006703_Cebpe_6
  gRNA
aaauacuaacaugccgccca

SEQ ID NO: 135925 - RNA, 20 nt, Artificial Sequence
  mmSKRIPTE0006704_Cebpe_7
  gRNA
cuuaccuugaggacacgcaa

SEQ ID NO: 135926 - RNA, 20 nt, Artificial Sequence
  mmSKRIPTE0006705_Cebpe_8
  gRNA
gcguuggcuucauggcaaag

SEQ ID NO: 135927 - RNA, 20 nt, Artificial Sequence
  mmSKRIPTE0006706_Cebpe_9
  gRNA
gugugugagggauaggcgaa

SEQ ID NO: 135928 - RNA, 20 nt, Artificial Sequence
  mmSKRIPTE0006707_Dnaja3_1
  gRNA
caacuccucggggucaacag

SEQ ID NO: 135929 - RNA, 20 nt, Artificial Sequence
  mmSKRIPTE0006708_Dnaja3_2
  gRNA
cguacuguagaacucccacg

SEQ ID NO: 135930 - RNA, 20 nt, Artificial Sequence
  mmSKRIPTE0006709_Dnaja3_3
  gRNA
ucaaugucagcagcgcccgg

SEQ ID NO: 135931 - RNA, 20 nt, Artificial Sequence
  mmSKRIPTE0006710_Dnaja3_4
  gRNA
gggaauaggcccuauagcug

SEQ ID NO: 135932 - RNA, 20 nt, Artificial Sequence
  mmSKRIPTE0006711_Dnaja3_5
  gRNA
cacgcacugagccaguggug

SEQ ID NO: 135933 - RNA, 20 nt, Artificial Sequence
  mmSKRIPTE0006712_Dnaja3_6
  gRNA
aaugacaauaccaucgguga

SEQ ID NO: 135934 - RNA, 20 nt, Artificial Sequence
  mmSKRIPTE0006713_Dnaja3_7
  gRNA
guugccacuacgccccccug

SEQ ID NO: 135935 - RNA, 20 nt, Artificial Sequence
  mmSKRIPTE0006714_Dnaja3_8
  gRNA
ugugacgguaagagggcaug

SEQ ID NO: 135936 - RNA, 20 nt, Artificial Sequence
  mmSKRIPTE0006715_Dnaja3_9
  gRNA
ucacacccgcccucccaaug

SEQ ID NO: 135937 - RNA, 20 nt, Artificial Sequence
  mmSKRIPTE0006716_Igll1_1
  gRNA
gaucgacaagacucucuggu

SEQ ID NO: 135938 - RNA, 20 nt, Artificial Sequence
  mmSKRIPTE0006717_Igll1_2
  gRNA
cguguagguccacggacuag

SEQ ID NO: 135939 - RNA, 20 nt, Artificial Sequence
  mmSKRIPTE0006718_Igll1_3
  gRNA
cuguuccagaucaucccacg

SEQ ID NO: 135940 - RNA, 20 nt, Artificial Sequence
  mmSKRIPTE0006719_Igll1_4
  gRNA
gcucaccaaacacacuagug

SEQ ID NO: 135941 - RNA, 20 nt, Artificial Sequence
  mmSKRIPTE0006720_Igll1_5
  gRNA
cacuggccuugcaaugaucg

SEQ ID NO: 135942 - RNA, 20 nt, Artificial Sequence
  mmSKRIPTE0006721_Igll1_6
  gRNA
ccugcuguauaagggcuucg

SEQ ID NO: 135943 - RNA, 20 nt, Artificial Sequence
  mmSKRIPTE0006722_Igll1_7
  gRNA
aaggacgcuuccuuaucacg

SEQ ID NO: 135944 - RNA, 20 nt, Artificial Sequence
  mmSKRIPTE0006723_Igll1_8
  gRNA
acaccucagcaucuaaaccg

SEQ ID NO: 135945 - RNA, 20 nt, Artificial Sequence
  mmSKRIPTE0006724_Igll1_9
  gRNA
cggcagcuguaucuacugug

SEQ ID NO: 135946 - RNA, 20 nt, Artificial Sequence
  mmSKRIPTE0006725_Tnfsf14_1
  gRNA
aaccaccggagacggcgcug

SEQ ID NO: 135947 - RNA, 20 nt, Artificial Sequence
  mmSKRIPTE0006726_Tnfsf14_2
  gRNA
cauaccagugagacucggag

SEQ ID NO: 135948 - RNA, 20 nt, Artificial Sequence
  mmSKRIPTE0006727_Tnfsf14_3
  gRNA
gcgcacaucccgcuacccga

SEQ ID NO: 135949 - RNA, 20 nt, Artificial Sequence
  mmSKRIPTE0006728_Tnfsf14_4
  gRNA
cuggugagaucguugaucug

SEQ ID NO: 135950 - RNA, 20 nt, Artificial Sequence
  mmSKRIPTE0006729_Tnfsf14_5
  gRNA
agucgugucucccauaacag

SEQ ID NO: 135951 - RNA, 20 nt, Artificial Sequence
  mmSKRIPTE0006730_Tnfsf14_6
  gRNA
uaggaccuggugccgucacg

SEQ ID NO: 135952 - RNA, 20 nt, Artificial Sequence
  mmSKRIPTE0006731_Tnfsf14_7
  gRNA
uagaacugcuggucagucgg

SEQ ID NO: 135953 - RNA, 20 nt, Artificial Sequence
  mmSKRIPTE0006732_Tnfsf14_8
  gRNA
gagugucaucaggaccaugu

SEQ ID NO: 135954 - RNA, 20 nt, Artificial Sequence
  mmSKRIPTE0006733_Tnfsf14_9
  gRNA
cagugagagugaucgaccgg

SEQ ID NO: 135955 - RNA, 20 nt, Artificial Sequence
  mmSKRIPTE0006734_Nfauc1_1
  gRNA
ucugugaccaauacggacac

SEQ ID NO: 135956 - RNA, 20 nt, Artificial Sequence
  mmSKRIPTE0006735_Nfauc1_2
  gRNA
uucggucacacugacccgag

SEQ ID NO: 135957 - RNA, 20 nt, Artificial Sequence
  mmSKRIPTE0006736_Nfauc1_3
  gRNA
ugacgcuucuacacagcgug

SEQ ID NO: 135958 - RNA, 20 nt, Artificial Sequence
  mmSKRIPTE0006737_Nfauc1_4
  gRNA
uuacauaaacaagcggcucg

SEQ ID NO: 135959 - RNA, 20 nt, Artificial Sequence
  mmSKRIPTE0006738_Nfauc1_5
  gRNA
gacaccuuggacuagacuag

SEQ ID NO: 135960 - RNA, 20 nt, Artificial Sequence
  mmSKRIPTE0006739_Nfauc1_6
  gRNA
aggaacagcugagauacccg

SEQ ID NO: 135961 - RNA, 20 nt, Artificial Sequence
  mmSKRIPTE0006740_Nfauc1_7
  gRNA
accaugcuugaaguauaggu

SEQ ID NO: 135962 - RNA, 20 nt, Artificial Sequence
  mmSKRIPTE0006741_Nfauc1_8
  gRNA
ugcgagccauguaagccaag

SEQ ID NO: 135963 - RNA, 20 nt, Artificial Sequence
  mmSKRIPTE0006742_Nfauc1_9
  gRNA
uacugaaacagaccuucgag

SEQ ID NO: 135964 - RNA, 20 nt, Artificial Sequence
  mmSKRIPTE0006743_Hck_1
  gRNA
ugggaugcgcagucuacgaa

SEQ ID NO: 135965 - RNA, 20 nt, Artificial Sequence
  mmSKRIPTE0006744_Hck_2
  gRNA
cuucaaggggaucagccgga

SEQ ID NO: 135966 - RNA, 20 nt, Artificial Sequence
  mmSKRIPTE0006745_Hck_3
  gRNA
cgggcugcccacgaagcgaa

SEQ ID NO: 135967 - RNA, 20 nt, Artificial Sequence
  mmSKRIPTE0006746_Hck_4
  gRNA
acaagagugagucuugcucg

SEQ ID NO: 135968 - RNA, 20 nt, Artificial Sequence
  mmSKRIPTE0006747_Hck_5
  gRNA
uccaucuggagggauucucg

SEQ ID NO: 135969 - RNA, 20 nt, Artificial Sequence
  mmSKRIPTE0006748_Hck_6
  gRNA
uggacuggcacgaaucaucg

SEQ ID NO: 135970 - RNA, 20 nt, Artificial Sequence
  mmSKRIPTE0006749_Hck_7
  gRNA
gugauuccucugucgcccag

SEQ ID NO: 135971 - RNA, 20 nt, Artificial Sequence
  mmSKRIPTE0006750_Hck_8
  gRNA
cugcuggaagaaccgccccg

SEQ ID NO: 135972 - RNA, 20 nt, Artificial Sequence
  mmSKRIPTE0006751_Hck_9
  gRNA
gcacuauaagauccggacgc

SEQ ID NO: 135973 - RNA, 20 nt, Artificial Sequence
  mmSKRIPTE0006752_Cd40_1
  gRNA
aaggcccauuacacccacgc

SEQ ID NO: 135974 - RNA, 20 nt, Artificial Sequence
  mmSKRIPTE0006753_Cd40_2
  gRNA
uacuaaccgccgcuuccagu

SEQ ID NO: 135975 - RNA, 20 nt, Artificial Sequence
  mmSKRIPTE0006754_Cd40_3
  gRNA
uugaaaguuagccaagacgc

SEQ ID NO: 135976 - RNA, 20 nt, Artificial Sequence
  mmSKRIPTE0006755_Cd40_4
  gRNA
cugcaccagcaaggauugcg

SEQ ID NO: 135977 - RNA, 20 nt, Artificial Sequence
  mmSKRIPTE0006756_Cd40_5
  gRNA
caaugccacuuacacgaccc

SEQ ID NO: 135978 - RNA, 20 nt, Artificial Sequence
  mmSKRIPTE0006757_Cd40_6
  gRNA
cauugggagcacccgccagu

SEQ ID NO: 135979 - RNA, 20 nt, Artificial Sequence
  mmSKRIPTE0006758_Cd40_7
  gRNA
caggcgaauucucagcccag

SEQ ID NO: 135980 - RNA, 20 nt, Artificial Sequence
  mmSKRIPTE0006759_Cd40_8
  gRNA
ggguucugaauuguccaccc

SEQ ID NO: 135981 - RNA, 20 nt, Artificial Sequence
  mmSKRIPTE0006760_Cd40_9
  gRNA
ucuuacccccugcggcucga

SEQ ID NO: 135982 - RNA, 20 nt, Artificial Sequence
  mmSKRIPTE0006761_Rarres2_1
  gRNA
ggagacgauaugcuccugcu

SEQ ID NO: 135983 - RNA, 20 nt, Artificial Sequence
  mmSKRIPTE0006762_Rarres2_2
  gRNA
ucaugggcaauauaccacgu

SEQ ID NO: 135984 - RNA, 20 nt, Artificial Sequence
  mmSKRIPTE0006763_Rarres2_3
  gRNA
accagcaggauuacuucccg

SEQ ID NO: 135985 - RNA, 20 nt, Artificial Sequence
  mmSKRIPTE0006764_Rarres2_4
  gRNA
gaggugacaugcgagccaga

SEQ ID NO: 135986 - RNA, 20 nt, Artificial Sequence
  mmSKRIPTE0006765_Rarres2_5
  gRNA
cacuugugaauacacccacg

SEQ ID NO: 135987 - RNA, 20 nt, Artificial Sequence
  mmSKRIPTE0006766_Rarres2_6
  gRNA
aagcgcugugcccaucacca

SEQ ID NO: 135988 - RNA, 20 nt, Artificial Sequence
  mmSKRIPTE0006767_Rarres2_7
  gRNA
auagcaguagugucacccua

SEQ ID NO: 135989 - RNA, 20 nt, Artificial Sequence
  mmSKRIPTE0006768_Rarres2_8
  gRNA
auaagcccuagacagguaag

SEQ ID NO: 135990 - RNA, 20 nt, Artificial Sequence
  mmSKRIPTE0006769_Rarres2_9
  gRNA
acccccaggggaaugucccg

SEQ ID NO: 135991 - RNA, 20 nt, Artificial Sequence
  mmSKRIPTE0006770_Necuin2_1
  gRNA
ugauuacgcgaggugcagag

SEQ ID NO: 135992 - RNA, 20 nt, Artificial Sequence
  mmSKRIPTE0006771_Necuin2_2
  gRNA
ucuucguguaccgaucggcu

SEQ ID NO: 135993 - RNA, 20 nt, Artificial Sequence
  mmSKRIPTE0006772_Necuin2_3
  gRNA
aggaaacaggugaaaacgcg

SEQ ID NO: 135994 - RNA, 20 nt, Artificial Sequence
  mmSKRIPTE0006773_Necuin2_4
  gRNA
acuuuacaaacgucucaaca

SEQ ID NO: 135995 - RNA, 20 nt, Artificial Sequence
  mmSKRIPTE0006774_Necuin2_5
  gRNA
gucggugacaaucuggacgg

SEQ ID NO: 135996 - RNA, 20 nt, Artificial Sequence
  mmSKRIPTE0006775_Necuin2_6
  gRNA
gggccgaacgaacugauccg

SEQ ID NO: 135997 - RNA, 20 nt, Artificial Sequence
  mmSKRIPTE0006776_Necuin2_7
  gRNA
ugccuugucggaaaaccucg

SEQ ID NO: 135998 - RNA, 20 nt, Artificial Sequence
  mmSKRIPTE0006777_Necuin2_8
  gRNA
aaacugcccgccgagagaug

SEQ ID NO: 135999 - RNA, 20 nt, Artificial Sequence
  mmSKRIPTE0006778_Necuin2_9
  gRNA
agugagacccuguauaacgu

SEQ ID NO: 136000 - RNA, 20 nt, Artificial Sequence
  mmSKRIPTE0006779_Nlrp9b_1
  gRNA
uuggagacaucgaauuacag

SEQ ID NO: 136001 - RNA, 20 nt, Artificial Sequence
  mmSKRIPTE0006780_Nlrp9b_2
  gRNA
cugaauccgauaaggcagug

SEQ ID NO: 136002 - RNA, 20 nt, Artificial Sequence
  mmSKRIPTE0006781_Nlrp9b_3
  gRNA
ccaagggugauaacuaugca

SEQ ID NO: 136003 - RNA, 20 nt, Artificial Sequence
  mmSKRIPTE0006782_Nlrp9b_4
  gRNA
gagaugcucagcaugcagag

SEQ ID NO: 136004 - RNA, 20 nt, Artificial Sequence
  mmSKRIPTE0006783_Nlrp9b_5
  gRNA
uccuucuuugauaaccagag

SEQ ID NO: 136005 - RNA, 20 nt, Artificial Sequence
  mmSKRIPTE0006784_Nlrp9b_6
  gRNA
gucaaucauuguccacaccc

SEQ ID NO: 136006 - RNA, 20 nt, Artificial Sequence
  mmSKRIPTE0006785_Nlrp9b_7
  gRNA
cuaggaaacauguaugcucg

SEQ ID NO: 136007 - RNA, 20 nt, Artificial Sequence
  mmSKRIPTE0006786_Nlrp9b_8
  gRNA
aaacauugcaaagugaugcg

SEQ ID NO: 136008 - RNA, 20 nt, Artificial Sequence
  mmSKRIPTE0006787_Nlrp9b_9
  gRNA
cuauaagcuagcaguccccc

SEQ ID NO: 136009 - RNA, 20 nt, Artificial Sequence
  mmSKRIPTE0006788_Ets1_1
  gRNA
aauucccgcugaccgccccg

SEQ ID NO: 136010 - RNA, 20 nt, Artificial Sequence
  mmSKRIPTE0006789_Ets1_2
  gRNA
uuaccuccagguaaacucgg

SEQ ID NO: 136011 - RNA, 20 nt, Artificial Sequence
  mmSKRIPTE0006790_Ets1_3
  gRNA
caaacuuacucucaucccgc

SEQ ID NO: 136012 - RNA, 20 nt, Artificial Sequence
  mmSKRIPTE0006791_Ets1_4
  gRNA
cccacauaccgucuauacca

SEQ ID NO: 136013 - RNA, 20 nt, Artificial Sequence
  mmSKRIPTE0006792_Ets1_5
  gRNA
ccuggacaaugaaggaaccg

SEQ ID NO: 136014 - RNA, 20 nt, Artificial Sequence
  mmSKRIPTE0006793_Ets1_6
  gRNA
ucugguucagggaacguacg

SEQ ID NO: 136015 - RNA, 20 nt, Artificial Sequence
  mmSKRIPTE0006794_Ets1_7
  gRNA
cucucacaccuacgguaaag

SEQ ID NO: 136016 - RNA, 20 nt, Artificial Sequence
  mmSKRIPTE0006795_Ets1_8
  gRNA
gaagccacaacaacucacca

SEQ ID NO: 136017 - RNA, 20 nt, Artificial Sequence
  mmSKRIPTE0006796_Ets1_9
  gRNA
gaacugguacagaauucggu

SEQ ID NO: 136018 - RNA, 20 nt, Artificial Sequence
  mmSKRIPTE0006797_Cruam_1
  gRNA
uaacuaaagcaugaccuccg

SEQ ID NO: 136019 - RNA, 20 nt, Artificial Sequence
  mmSKRIPTE0006798_Cruam_2
  gRNA
auaaaaguggcccgucaggu

SEQ ID NO: 136020 - RNA, 20 nt, Artificial Sequence
  mmSKRIPTE0006799_Cruam_3
  gRNA
gauguggcuaaagcucaucu

SEQ ID NO: 136021 - RNA, 20 nt, Artificial Sequence
  mmSKRIPTE0006800_Cruam_4
  gRNA
aguggacagagaaccccgug

SEQ ID NO: 136022 - RNA, 20 nt, Artificial Sequence
  mmSKRIPTE0006801_Cruam_5
  gRNA
cagaucaagauccaacaacg

SEQ ID NO: 136023 - RNA, 20 nt, Artificial Sequence
  mmSKRIPTE0006802_Cruam_6
  gRNA
uucaugcaacgcuuagacug

SEQ ID NO: 136024 - RNA, 20 nt, Artificial Sequence
  mmSKRIPTE0006803_Cruam_7
  gRNA
uuacuuaugaugugauggug

SEQ ID NO: 136025 - RNA, 20 nt, Artificial Sequence
  mmSKRIPTE0006804_Cruam_8
  gRNA
ugggauguuacagcacgcag

SEQ ID NO: 136026 - RNA, 20 nt, Artificial Sequence
  mmSKRIPTE0006805_Cruam_9
  gRNA
agcauacaggacuggcccgg

SEQ ID NO: 136027 - RNA, 20 nt, Artificial Sequence
  mmSKRIPTE0006806_Msn_1
  gRNA
aucaaagcuccauuacccug

SEQ ID NO: 136028 - RNA, 20 nt, Artificial Sequence
  mmSKRIPTE0006807_Msn_2
  gRNA
gaauaauccccacuccacgg

SEQ ID NO: 136029 - RNA, 20 nt, Artificial Sequence
  mmSKRIPTE0006808_Msn_3
  gRNA
cgcuuguuaauccgaagccg

SEQ ID NO: 136030 - RNA, 20 nt, Artificial Sequence
  mmSKRIPTE0006809_Msn_4
  gRNA
gcuauacugaacguuuggca

SEQ ID NO: 136031 - RNA, 20 nt, Artificial Sequence
  mmSKRIPTE0006810_Msn_5
  gRNA
aggcugcgugcaaucuugag

SEQ ID NO: 136032 - RNA, 20 nt, Artificial Sequence
  mmSKRIPTE0006811_Msn_6
  gRNA
gugccgacaacuagcgcggu

SEQ ID NO: 136033 - RNA, 20 nt, Artificial Sequence
  mmSKRIPTE0006812_Msn_7
  gRNA
gugaagcucauggcuaucag

SEQ ID NO: 136034 - RNA, 20 nt, Artificial Sequence
  mmSKRIPTE0006813_Msn_8
  gRNA
ggguguacaaacuagaagug

SEQ ID NO: 136035 - RNA, 20 nt, Artificial Sequence
  mmSKRIPTE0006814_Msn_9
  gRNA
caccuacguuggccagauga

SEQ ID NO: 136036 - RNA, 20 nt, Artificial Sequence
  mmSKRIPTE0006815_Vegfd_1
  gRNA
gcaagcacuuacaacccgua

SEQ ID NO: 136037 - RNA, 20 nt, Artificial Sequence
  mmSKRIPTE0006816_Vegfd_2
  gRNA
gaggguaacccaucauagug

SEQ ID NO: 136038 - RNA, 20 nt, Artificial Sequence
  mmSKRIPTE0006817_Vegfd_3
  gRNA
cuagaaccuugagcguaggg

SEQ ID NO: 136039 - RNA, 20 nt, Artificial Sequence
  mmSKRIPTE0006818_Vegfd_4
  gRNA
gcacgguaguuaugcaucag

SEQ ID NO: 136040 - RNA, 20 nt, Artificial Sequence
  mmSKRIPTE0006819_Vegfd_5
  gRNA
uaauugaguaaggauggcgg

SEQ ID NO: 136041 - RNA, 20 nt, Artificial Sequence
  mmSKRIPTE0006820_Vegfd_6
  gRNA
uacaggaauaacguucauug

SEQ ID NO: 136042 - RNA, 20 nt, Artificial Sequence
  mmSKRIPTE0006821_Vegfd_7
  gRNA
ggaggcugcugcaacgaaga

SEQ ID NO: 136043 - RNA, 20 nt, Artificial Sequence
  mmSKRIPTE0006822_Vegfd_8
  gRNA
ggaaacaacugcuuagucau

SEQ ID NO: 136044 - RNA, 20 nt, Artificial Sequence
  mmSKRIPTE0006823_Vegfd_9
  gRNA
ucuucaucaaacgucaugug

SEQ ID NO: 136045 - RNA, 20 nt, Artificial Sequence
  mmSKRIPTE0006824_Dusp10_1
  gRNA
augguacagaggaaggugcg

SEQ ID NO: 136046 - RNA, 20 nt, Artificial Sequence
  mmSKRIPTE0006825_Dusp10_2
  gRNA
ggccugaugauccuugucgu

SEQ ID NO: 136047 - RNA, 20 nt, Artificial Sequence
  mmSKRIPTE0006826_Dusp10_3
  gRNA
ccagcuccaagagugccggg

SEQ ID NO: 136048 - RNA, 20 nt, Artificial Sequence
  mmSKRIPTE0006827_Dusp10_4
  gRNA
gacucgaggacuaugugaag

SEQ ID NO: 136049 - RNA, 20 nt, Artificial Sequence
  mmSKRIPTE0006828_Dusp10_5
  gRNA
acgggucacucagagccgga

SEQ ID NO: 136050 - RNA, 20 nt, Artificial Sequence
  mmSKRIPTE0006829_Dusp10_6
  gRNA
gagcauccugcucauugccg

SEQ ID NO: 136051 - RNA, 20 nt, Artificial Sequence
  mmSKRIPTE0006830_Dusp10_7
  gRNA
gguagcuugagucuaaacaa

SEQ ID NO: 136052 - RNA, 20 nt, Artificial Sequence
  mmSKRIPTE0006831_Dusp10_8
  gRNA
gacgcuuacaaauucgucaa

SEQ ID NO: 136053 - RNA, 20 nt, Artificial Sequence
  mmSKRIPTE0006832_Dusp10_9
  gRNA
gaaugacacauccccaaacg

SEQ ID NO: 136054 - RNA, 20 nt, Artificial Sequence
  mmSKRIPTE0006833_Raet1e_1
  gRNA
uccuggcacaaaucguucag

SEQ ID NO: 136055 - RNA, 20 nt, Artificial Sequence
  mmSKRIPTE0006834_Raet1e_2
  gRNA
gugugacgugaagugcucag

SEQ ID NO: 136056 - RNA, 20 nt, Artificial Sequence
  mmSKRIPTE0006835_Raet1e_3
  gRNA
gaacucaccauccagcccgu

SEQ ID NO: 136057 - RNA, 20 nt, Artificial Sequence
  mmSKRIPTE0006836_Raet1e_4
  gRNA
gucaaacugagguugcaacu

SEQ ID NO: 136058 - RNA, 20 nt, Artificial Sequence
  mmSKRIPTE0006837_Raet1e_5
  gRNA
cucugaauauuauuaaaccc

SEQ ID NO: 136059 - RNA, 20 nt, Artificial Sequence
  mmSKRIPTE0006838_Raet1e_6
  gRNA
ucuacacagagaauaugagc

SEQ ID NO: 136060 - RNA, 20 nt, Artificial Sequence
  mmSKRIPTE0006839_Raet1e_7
  gRNA
ggcagagacauugacaagag

SEQ ID NO: 136061 - RNA, 20 nt, Artificial Sequence
  mmSKRIPTE0006840_Raet1e_8
  gRNA
uuugcauuugcgaugugaag

SEQ ID NO: 136062 - RNA, 20 nt, Artificial Sequence
  mmSKRIPTE0006841_Raet1e_9
  gRNA
uucuuagaaguagaguggcu

SEQ ID NO: 136063 - RNA, 20 nt, Artificial Sequence
  mmSKRIPTE0006842_Irak3_1
  gRNA
acguuagaucuggucuaacg

SEQ ID NO: 136064 - RNA, 20 nt, Artificial Sequence
  mmSKRIPTE0006843_Irak3_2
  gRNA
uuacagugcacaguaagucg

SEQ ID NO: 136065 - RNA, 20 nt, Artificial Sequence
  mmSKRIPTE0006844_Irak3_3
  gRNA
uuccaugaggaggucccgcu

SEQ ID NO: 136066 - RNA, 20 nt, Artificial Sequence
  mmSKRIPTE0006845_Irak3_4
  gRNA
gucaugucccaagacgggga

SEQ ID NO: 136067 - RNA, 20 nt, Artificial Sequence
  mmSKRIPTE0006846_Irak3_5
  gRNA
gucaccgccuuucacaaccg

SEQ ID NO: 136068 - RNA, 20 nt, Artificial Sequence
  mmSKRIPTE0006847_Irak3_6
  gRNA
ggccaaguuaagacccacga

SEQ ID NO: 136069 - RNA, 20 nt, Artificial Sequence
  mmSKRIPTE0006848_Irak3_7
  gRNA
aagugagacuuucaguacgu

SEQ ID NO: 136070 - RNA, 20 nt, Artificial Sequence
  mmSKRIPTE0006849_Irak3_8
  gRNA
uugccacagaugacggcgca

SEQ ID NO: 136071 - RNA, 20 nt, Artificial Sequence
  mmSKRIPTE0006850_Irak3_9
  gRNA
ucugcugcucuagauugggu

SEQ ID NO: 136072 - RNA, 20 nt, Artificial Sequence
  mmSKRIPTE0006851_Ighe_1
  gRNA
ccguggcucaugaucugucg

SEQ ID NO: 136073 - RNA, 20 nt, Artificial Sequence
  mmSKRIPTE0006852_Ighe_2
  gRNA
ugacaggucgaacuagggca

SEQ ID NO: 136074 - RNA, 20 nt, Artificial Sequence
  mmSKRIPTE0006853_Ighe_3
  gRNA
guggugcuuaguguaccacu

SEQ ID NO: 136075 - RNA, 20 nt, Artificial Sequence
  mmSKRIPTE0006854_Ighe_4
  gRNA
ugggaacacauauaccucgg

SEQ ID NO: 136076 - RNA, 20 nt, Artificial Sequence
  mmSKRIPTE0006855_Ighe_5
  gRNA
gggagacccaacauacucgg

SEQ ID NO: 136077 - RNA, 20 nt, Artificial Sequence
  mmSKRIPTE0006856_Ighe_6
  gRNA
aggcgaguguagaccuaccu

SEQ ID NO: 136078 - RNA, 20 nt, Artificial Sequence
  mmSKRIPTE0006857_Ighe_7
  gRNA
ggaugaauggaguagcucca

SEQ ID NO: 136079 - RNA, 20 nt, Artificial Sequence
  mmSKRIPTE0006858_Ighe_8
  gRNA
augauggaggaugugucacg

SEQ ID NO: 136080 - RNA, 20 nt, Artificial Sequence
  mmSKRIPTE0006859_Ighe_9
  gRNA
caccugccaagugauccaug

SEQ ID NO: 136081 - RNA, 20 nt, Artificial Sequence
  mmSKRIPTE0006860_Irf4_1
  gRNA
aaugcugagauagcggaccc

SEQ ID NO: 136082 - RNA, 20 nt, Artificial Sequence
  mmSKRIPTE0006861_Irf4_2
  gRNA
cgcaucccguggaaacacgc

SEQ ID NO: 136083 - RNA, 20 nt, Artificial Sequence
  mmSKRIPTE0006862_Irf4_3
  gRNA
cggugacuagacugauacga

SEQ ID NO: 136084 - RNA, 20 nt, Artificial Sequence
  mmSKRIPTE0006863_Irf4_4
  gRNA
cacccguaaaucacacacug

SEQ ID NO: 136085 - RNA, 20 nt, Artificial Sequence
  mmSKRIPTE0006864_Irf4_5
  gRNA
gcagccuucagggcucgucg

SEQ ID NO: 136086 - RNA, 20 nt, Artificial Sequence
  mmSKRIPTE0006865_Irf4_6
  gRNA
cuccaaguucaugacgcgug

SEQ ID NO: 136087 - RNA, 20 nt, Artificial Sequence
  mmSKRIPTE0006866_Irf4_7
  gRNA
uguagccguuguuagaucag

SEQ ID NO: 136088 - RNA, 20 nt, Artificial Sequence
  mmSKRIPTE0006867_Irf4_8
  gRNA
gcguguacagcccauacuag

SEQ ID NO: 136089 - RNA, 20 nt, Artificial Sequence
  mmSKRIPTE0006868_Irf4_9
  gRNA
caugccuacuccagaccccg

SEQ ID NO: 136090 - RNA, 20 nt, Artificial Sequence
  mmSKRIPTE0006869_Ubqln1_1
  gRNA
acaucaaugcagcaaucgaa

SEQ ID NO: 136091 - RNA, 20 nt, Artificial Sequence
  mmSKRIPTE0006870_Ubqln1_2
  gRNA
acaucgcugagagcgugucg

SEQ ID NO: 136092 - RNA, 20 nt, Artificial Sequence
  mmSKRIPTE0006871_Ubqln1_3
  gRNA
agcgagaguguccuucuccg

SEQ ID NO: 136093 - RNA, 20 nt, Artificial Sequence
  mmSKRIPTE0006872_Ubqln1_4
  gRNA
ccagucuuguaaucaaugcg

SEQ ID NO: 136094 - RNA, 20 nt, Artificial Sequence
  mmSKRIPTE0006873_Ubqln1_5
  gRNA
gcucacgcagcggaacccag

SEQ ID NO: 136095 - RNA, 20 nt, Artificial Sequence
  mmSKRIPTE0006874_Ubqln1_6
  gRNA
ucauaccuaagccguagcau

SEQ ID NO: 136096 - RNA, 20 nt, Artificial Sequence
  mmSKRIPTE0006875_Ubqln1_7
  gRNA
gugguauccucuccgcacgu

SEQ ID NO: 136097 - RNA, 20 nt, Artificial Sequence
  mmSKRIPTE0006876_Ubqln1_8
  gRNA
gcacaacuuaccuacgccaa

SEQ ID NO: 136098 - RNA, 20 nt, Artificial Sequence
  mmSKRIPTE0006877_Ubqln1_9
  gRNA
ggagaguccccgcguccaca

SEQ ID NO: 136099 - RNA, 20 nt, Artificial Sequence
  mmSKRIPTE0006878_Sp1_1
  gRNA
caagugugcucggagaugug

SEQ ID NO: 136100 - RNA, 20 nt, Artificial Sequence
  mmSKRIPTE0006879_Sp1_2
  gRNA
ucauucggacaccaaccgug

SEQ ID NO: 136101 - RNA, 20 nt, Artificial Sequence
  mmSKRIPTE0006880_Sp1_3
  gRNA
gugaaggucuguccggacaa

SEQ ID NO: 136102 - RNA, 20 nt, Artificial Sequence
  mmSKRIPTE0006881_Sp1_4
  gRNA
gcacccaauagcuggccuag

SEQ ID NO: 136103 - RNA, 20 nt, Artificial Sequence
  mmSKRIPTE0006882_Sp1_5
  gRNA
agugcccuaagcguuucaug

SEQ ID NO: 136104 - RNA, 20 nt, Artificial Sequence
  mmSKRIPTE0006883_Sp1_6
  gRNA
ugaguccacuccgagccuag

SEQ ID NO: 136105 - RNA, 20 nt, Artificial Sequence
  mmSKRIPTE0006884_Sp1_7
  gRNA
aaggcgggcugccuacccaa

SEQ ID NO: 136106 - RNA, 20 nt, Artificial Sequence
  mmSKRIPTE0006885_Sp1_8
  gRNA
acagccgcacaacuuucaca

SEQ ID NO: 136107 - RNA, 20 nt, Artificial Sequence
  mmSKRIPTE0006886_Sp1_9
  gRNA
agaaggaaggggcgguuucg

SEQ ID NO: 136108 - RNA, 20 nt, Artificial Sequence
  mmSKRIPTE0006887_Ebi3_1
  gRNA
uacgcuccaacagaggcgau

SEQ ID NO: 136109 - RNA, 20 nt, Artificial Sequence
  mmSKRIPTE0006888_Ebi3_2
  gRNA
uggagaacaggugcacgucg

SEQ ID NO: 136110 - RNA, 20 nt, Artificial Sequence
  mmSKRIPTE0006889_Ebi3_3
  gRNA
aguaugaaugaacggcagga

SEQ ID NO: 136111 - RNA, 20 nt, Artificial Sequence
  mmSKRIPTE0006890_Ebi3_4
  gRNA
gucaagccggacccuccgga

SEQ ID NO: 136112 - RNA, 20 nt, Artificial Sequence
  mmSKRIPTE0006891_Ebi3_5
  gRNA
aguaacgcuagauaagcacu

SEQ ID NO: 136113 - RNA, 20 nt, Artificial Sequence
  mmSKRIPTE0006892_Ebi3_6
  gRNA
gauguugccaaggauuggua

SEQ ID NO: 136114 - RNA, 20 nt, Artificial Sequence
  mmSKRIPTE0006893_Ebi3_7
  gRNA
accuguuucaguguaaccag

SEQ ID NO: 136115 - RNA, 20 nt, Artificial Sequence
  mmSKRIPTE0006894_Ebi3_8
  gRNA
cccucaaguagacgacauca

SEQ ID NO: 136116 - RNA, 20 nt, Artificial Sequence
  mmSKRIPTE0006895_Ebi3_9
  gRNA
ucgcuccaugggaacgcacg

SEQ ID NO: 136117 - RNA, 20 nt, Artificial Sequence
  mmSKRIPTE0006896_Eif2ak2_1
  gRNA
uaagcgcguuaaauauaaca

SEQ ID NO: 136118 - RNA, 20 nt, Artificial Sequence
  mmSKRIPTE0006897_Eif2ak2_2
  gRNA
ucagagaacguguuuacggu

SEQ ID NO: 136119 - RNA, 20 nt, Artificial Sequence
  mmSKRIPTE0006898_Eif2ak2_3
  gRNA
guaaugggaugcaagcacgc

SEQ ID NO: 136120 - RNA, 20 nt, Artificial Sequence
  mmSKRIPTE0006899_Eif2ak2_4
  gRNA
aaguuucuggauccggacag

SEQ ID NO: 136121 - RNA, 20 nt, Artificial Sequence
  mmSKRIPTE0006900_Eif2ak2_5
  gRNA
gcacccgcgagaagucaggu

SEQ ID NO: 136122 - RNA, 20 nt, Artificial Sequence
  mmSKRIPTE0006901_Eif2ak2_6
  gRNA
uaacuggcaacacauaccgg

SEQ ID NO: 136123 - RNA, 20 nt, Artificial Sequence
  mmSKRIPTE0006902_Eif2ak2_7
  gRNA
uaaggauggucauacgauug

SEQ ID NO: 136124 - RNA, 20 nt, Artificial Sequence
  mmSKRIPTE0006903_Eif2ak2_8
  gRNA
gcccggguucgaaucccgaa

SEQ ID NO: 136125 - RNA, 20 nt, Artificial Sequence
  mmSKRIPTE0006904_Eif2ak2_9
  gRNA
acagcaugagugauacaagu

SEQ ID NO: 136126 - RNA, 20 nt, Artificial Sequence
  mmSKRIPTE0006905_Riok3_1
  gRNA
acuaguacagcggugacgga

SEQ ID NO: 136127 - RNA, 20 nt, Artificial Sequence
  mmSKRIPTE0006906_Riok3_2
  gRNA
ucagcgaguauaacauguug

SEQ ID NO: 136128 - RNA, 20 nt, Artificial Sequence
  mmSKRIPTE0006907_Riok3_3
  gRNA
acucagguuacguuuccuga

SEQ ID NO: 136129 - RNA, 20 nt, Artificial Sequence
  mmSKRIPTE0006908_Riok3_4
  gRNA
gacccaguaaggugagcgag

SEQ ID NO: 136130 - RNA, 20 nt, Artificial Sequence
  mmSKRIPTE0006909_Riok3_5
  gRNA
acguaagaucauccgcaugu

SEQ ID NO: 136131 - RNA, 20 nt, Artificial Sequence
  mmSKRIPTE0006910_Riok3_6
  gRNA
gagauccuuaguauacaggg

SEQ ID NO: 136132 - RNA, 20 nt, Artificial Sequence
  mmSKRIPTE0006911_Riok3_7
  gRNA
cgagacgaucccuacagacc

SEQ ID NO: 136133 - RNA, 20 nt, Artificial Sequence
  mmSKRIPTE0006912_Riok3_8
  gRNA
agaaaggugcuuucacaccg

SEQ ID NO: 136134 - RNA, 20 nt, Artificial Sequence
  mmSKRIPTE0006913_Riok3_9
  gRNA
gcuucgcucagggugcuccg

SEQ ID NO: 136135 - RNA, 20 nt, Artificial Sequence
  mmSKRIPTE0006914_Tlx1_1
  gRNA
gcucacucgucuaaaccgau

SEQ ID NO: 136136 - RNA, 20 nt, Artificial Sequence
  mmSKRIPTE0006915_Tlx1_2
  gRNA
uugguggagucgucagacca

SEQ ID NO: 136137 - RNA, 20 nt, Artificial Sequence
  mmSKRIPTE0006916_Tlx1_3
  gRNA
cuggagaccacaaacaacga

SEQ ID NO: 136138 - RNA, 20 nt, Artificial Sequence
  mmSKRIPTE0006917_Tlx1_4
  gRNA
ccagugcgcucugacucgcg

SEQ ID NO: 136139 - RNA, 20 nt, Artificial Sequence
  mmSKRIPTE0006918_Tlx1_5
  gRNA
ugaagcgucucuuaaaacac

SEQ ID NO: 136140 - RNA, 20 nt, Artificial Sequence
  mmSKRIPTE0006919_Tlx1_6
  gRNA
auacggcguguuacagugaa

SEQ ID NO: 136141 - RNA, 20 nt, Artificial Sequence
  mmSKRIPTE0006920_Tlx1_7
  gRNA
ggggcccuaaccaaacuuug

SEQ ID NO: 136142 - RNA, 20 nt, Artificial Sequence
  mmSKRIPTE0006921_Tlx1_8
  gRNA
aaaugagcagcgucuaccca

SEQ ID NO: 136143 - RNA, 20 nt, Artificial Sequence
  mmSKRIPTE0006922_Tlx1_9
  gRNA
aacuuaggaaacgcacggag

SEQ ID NO: 136144 - RNA, 20 nt, Artificial Sequence
  mmSKRIPTE0006923_Wnt4_1
  gRNA
gugauggacucagugcgccg

SEQ ID NO: 136145 - RNA, 20 nt, Artificial Sequence
  mmSKRIPTE0006924_Wnt4_2
  gRNA
gcgguccccaaguauaugug

SEQ ID NO: 136146 - RNA, 20 nt, Artificial Sequence
  mmSKRIPTE0006925_Wnt4_3
  gRNA
uaccaaccccaucgacacug

SEQ ID NO: 136147 - RNA, 20 nt, Artificial Sequence
  mmSKRIPTE0006926_Wnt4_4
  gRNA
ccucucccggacguccacaa

SEQ ID NO: 136148 - RNA, 20 nt, Artificial Sequence
  mmSKRIPTE0006927_Wnt4_5
  gRNA
ugcugaacuaagucuaccag

SEQ ID NO: 136149 - RNA, 20 nt, Artificial Sequence
  mmSKRIPTE0006928_Wnt4_6
  gRNA
ucgugccuagcacgccacug

SEQ ID NO: 136150 - RNA, 20 nt, Artificial Sequence
  mmSKRIPTE0006929_Wnt4_7
  gRNA
ggcuugaacugugcauuccg

SEQ ID NO: 136151 - RNA, 20 nt, Artificial Sequence
  mmSKRIPTE0006930_Wnt4_8
  gRNA
ccgagaacacggcgaagacg

SEQ ID NO: 136152 - RNA, 20 nt, Artificial Sequence
  mmSKRIPTE0006931_Wnt4_9
  gRNA
gcguggccaaccuggcggaa

SEQ ID NO: 136153 - RNA, 20 nt, Artificial Sequence
  mmSKRIPTE0006932_Tlr1_1
  gRNA
caaaccgaucguagugcuga

SEQ ID NO: 136154 - RNA, 20 nt, Artificial Sequence
  mmSKRIPTE0006933_Tlr1_2
  gRNA
uucuagguccuauacccaug

SEQ ID NO: 136155 - RNA, 20 nt, Artificial Sequence
  mmSKRIPTE0006934_Tlr1_3
  gRNA
ucaaaacucucaugucacga

SEQ ID NO: 136156 - RNA, 20 nt, Artificial Sequence
  mmSKRIPTE0006935_Tlr1_4
  gRNA
ucucuaagguacagcgaugg

SEQ ID NO: 136157 - RNA, 20 nt, Artificial Sequence
  mmSKRIPTE0006936_Tlr1_5
  gRNA
ugaacaauguggaaacaacg

SEQ ID NO: 136158 - RNA, 20 nt, Artificial Sequence
  mmSKRIPTE0006937_Tlr1_6
  gRNA
caaguucaaaacuuucaggg

SEQ ID NO: 136159 - RNA, 20 nt, Artificial Sequence
  mmSKRIPTE0006938_Tlr1_7
  gRNA
aaguaguuguuugcaagggu

SEQ ID NO: 136160 - RNA, 20 nt, Artificial Sequence
  mmSKRIPTE0006939_Tlr1_8
  gRNA
ugaagaacucaggcgagcag

SEQ ID NO: 136161 - RNA, 20 nt, Artificial Sequence
  mmSKRIPTE0006940_Tlr1_9
  gRNA
agaauaauugaacauccuga

SEQ ID NO: 136162 - RNA, 20 nt, Artificial Sequence
  mmSKRIPTE0006941_Pdgfra_1
  gRNA
aggaccguuccugaaccgac

SEQ ID NO: 136163 - RNA, 20 nt, Artificial Sequence
  mmSKRIPTE0006942_Pdgfra_2
  gRNA
guggcggcuuauaugaacaa

SEQ ID NO: 136164 - RNA, 20 nt, Artificial Sequence
  mmSKRIPTE0006943_Pdgfra_3
  gRNA
ucccaaccaagucccucgaa

SEQ ID NO: 136165 - RNA, 20 nt, Artificial Sequence
  mmSKRIPTE0006944_Pdgfra_4
  gRNA
gccagcggguaagaucagcg

SEQ ID NO: 136166 - RNA, 20 nt, Artificial Sequence
  mmSKRIPTE0006945_Pdgfra_5
  gRNA
ggugggagccgggaucacgu

SEQ ID NO: 136167 - RNA, 20 nt, Artificial Sequence
  mmSKRIPTE0006946_Pdgfra_6
  gRNA
auaguccuuucuaaccaacu

SEQ ID NO: 136168 - RNA, 20 nt, Artificial Sequence
  mmSKRIPTE0006947_Pdgfra_7
  gRNA
aaggaaucggucaucccgag

SEQ ID NO: 136169 - RNA, 20 nt, Artificial Sequence
  mmSKRIPTE0006948_Pdgfra_8
  gRNA
agggacaucccuccgcggaa

SEQ ID NO: 136170 - RNA, 20 nt, Artificial Sequence
  mmSKRIPTE0006949_Pdgfra_9
  gRNA
cugguggcgaucuuguggcg

SEQ ID NO: 136171 - RNA, 20 nt, Artificial Sequence
  mmSKRIPTE0006950_Pkn1_1
  gRNA
ugaguccgaugagaacugcg

SEQ ID NO: 136172 - RNA, 20 nt, Artificial Sequence
  mmSKRIPTE0006951_Pkn1_2
  gRNA
gcuccagaucauacuucacg

SEQ ID NO: 136173 - RNA, 20 nt, Artificial Sequence
  mmSKRIPTE0006952_Pkn1_3
  gRNA
caaccgcagugacaccgcag

SEQ ID NO: 136174 - RNA, 20 nt, Artificial Sequence
  mmSKRIPTE0006953_Pkn1_4
  gRNA
aaucgcucaaaauugcacag

SEQ ID NO: 136175 - RNA, 20 nt, Artificial Sequence
  mmSKRIPTE0006954_Pkn1_5
  gRNA
ggcgaucagcaucugcacgg

SEQ ID NO: 136176 - RNA, 20 nt, Artificial Sequence
  mmSKRIPTE0006955_Pkn1_6
  gRNA
augcuuagucgccaaucgag

SEQ ID NO: 136177 - RNA, 20 nt, Artificial Sequence
  mmSKRIPTE0006956_Pkn1_7
  gRNA
acuguguugcucuaugauag

SEQ ID NO: 136178 - RNA, 20 nt, Artificial Sequence
  mmSKRIPTE0006957_Pkn1_8
  gRNA
cuagcaacuauaggcucacg

SEQ ID NO: 136179 - RNA, 20 nt, Artificial Sequence
  mmSKRIPTE0006958_Pkn1_9
  gRNA
augggaaguaagccucacga

SEQ ID NO: 136180 - RNA, 20 nt, Artificial Sequence
  mmSKRIPTE0006959_Tgfbr2_1
  gRNA
gaagccgcaugaagucugcg

SEQ ID NO: 136181 - RNA, 20 nt, Artificial Sequence
  mmSKRIPTE0006960_Tgfbr2_2
  gRNA
gaaucccuaccuaguauccg

SEQ ID NO: 136182 - RNA, 20 nt, Artificial Sequence
  mmSKRIPTE0006961_Tgfbr2_3
  gRNA
ggccagcgacaauggcggug

SEQ ID NO: 136183 - RNA, 20 nt, Artificial Sequence
  mmSKRIPTE0006962_Tgfbr2_4
  gRNA
ggguaguaugagguacccga

SEQ ID NO: 136184 - RNA, 20 nt, Artificial Sequence
  mmSKRIPTE0006963_Tgfbr2_5
  gRNA
aacuuuacccgggcgccgag

SEQ ID NO: 136185 - RNA, 20 nt, Artificial Sequence
  mmSKRIPTE0006964_Tgfbr2_6
  gRNA
acgaggaguacuccucguag

SEQ ID NO: 136186 - RNA, 20 nt, Artificial Sequence
  mmSKRIPTE0006965_Tgfbr2_7
  gRNA
accugcaggaguaccucacg

SEQ ID NO: 136187 - RNA, 20 nt, Artificial Sequence
  mmSKRIPTE0006966_Tgfbr2_8
  gRNA
agaucuugcccggauccccg

SEQ ID NO: 136188 - RNA, 20 nt, Artificial Sequence
  mmSKRIPTE0006967_Tgfbr2_9
  gRNA
uuucgacaguguguugaucg

SEQ ID NO: 136189 - RNA, 20 nt, Artificial Sequence
  mmSKRIPTE0006968_Ppbp_1
  gRNA
gacgauucucuugacgccag

SEQ ID NO: 136190 - RNA, 20 nt, Artificial Sequence
  mmSKRIPTE0006969_Ppbp_2
  gRNA
aagaucuggagguuaugaag

SEQ ID NO: 136191 - RNA, 20 nt, Artificial Sequence
  mmSKRIPTE0006970_Ppbp_3
  gRNA
uaaggggagccagcgcaaca

SEQ ID NO: 136192 - RNA, 20 nt, Artificial Sequence
  mmSKRIPTE0006971_Ppbp_4
  gRNA
accuacaucguccugcacca

SEQ ID NO: 136193 - RNA, 20 nt, Artificial Sequence
  mmSKRIPTE0006972_Ppbp_5
  gRNA
ucaugugucuaagcggcuug

SEQ ID NO: 136194 - RNA, 20 nt, Artificial Sequence
  mmSKRIPTE0006973_Ppbp_6
  gRNA
ccaacccauaucaaccagac

SEQ ID NO: 136195 - RNA, 20 nt, Artificial Sequence
  mmSKRIPTE0006974_Ppbp_7
  gRNA
cucuucggcaguauaaaaag

SEQ ID NO: 136196 - RNA, 20 nt, Artificial Sequence
  mmSKRIPTE0006975_Ppbp_8
  gRNA
ucugucagaacagauccaug

SEQ ID NO: 136197 - RNA, 20 nt, Artificial Sequence
  mmSKRIPTE0006976_Ppbp_9
  gRNA
ccaguagcaccaaaagugug

SEQ ID NO: 136198 - RNA, 20 nt, Artificial Sequence
  mmSKRIPTE0006977_A2m_1
  gRNA
uaggcuuauugacagcaacg

SEQ ID NO: 136199 - RNA, 20 nt, Artificial Sequence
  mmSKRIPTE0006978_A2m_2
  gRNA
uguauuggguauacucgaug

SEQ ID NO: 136200 - RNA, 20 nt, Artificial Sequence
  mmSKRIPTE0006979_A2m_3
  gRNA
aaguccauaugccuuaaucg

SEQ ID NO: 136201 - RNA, 20 nt, Artificial Sequence
  mmSKRIPTE0006980_A2m_4
  gRNA
ugauacguacagaaucaggc

SEQ ID NO: 136202 - RNA, 20 nt, Artificial Sequence
  mmSKRIPTE0006981_A2m_5
  gRNA
uguucccuaccgauugaccu

SEQ ID NO: 136203 - RNA, 20 nt, Artificial Sequence
  mmSKRIPTE0006982_A2m_6
  gRNA
ccgguuuggauuguacagga

SEQ ID NO: 136204 - RNA, 20 nt, Artificial Sequence
  mmSKRIPTE0006983_A2m_7
  gRNA
ugauuuccuagcuaccccag

SEQ ID NO: 136205 - RNA, 20 nt, Artificial Sequence
  mmSKRIPTE0006984_A2m_8
  gRNA
ccucuggaagcaucccgaug

SEQ ID NO: 136206 - RNA, 20 nt, Artificial Sequence
  mmSKRIPTE0006985_A2m_9
  gRNA
cagacguauacuugguggag

SEQ ID NO: 136207 - RNA, 20 nt, Artificial Sequence
  mmSKRIPTE0006986_Il18bp_1
  gRNA
ucucucuaagguuagcgaag

SEQ ID NO: 136208 - RNA, 20 nt, Artificial Sequence
  mmSKRIPTE0006987_Il18bp_2
  gRNA
aggcaauguagaaccucaca

SEQ ID NO: 136209 - RNA, 20 nt, Artificial Sequence
  mmSKRIPTE0006988_Il18bp_3
  gRNA
gauacuccuagguucucacc

SEQ ID NO: 136210 - RNA, 20 nt, Artificial Sequence
  mmSKRIPTE0006989_Il18bp_4
  gRNA
gccaaaguuauaucucaacu

SEQ ID NO: 136211 - RNA, 20 nt, Artificial Sequence
  mmSKRIPTE0006990_Il18bp_5
  gRNA
acuguuccguccuugccuug

SEQ ID NO: 136212 - RNA, 20 nt, Artificial Sequence
  mmSKRIPTE0006991_Il18bp_6
  gRNA
cuacauucagcagagccgag

SEQ ID NO: 136213 - RNA, 20 nt, Artificial Sequence
  mmSKRIPTE0006992_Il18bp_7
  gRNA
guguaagcagagcuaucacu

SEQ ID NO: 136214 - RNA, 20 nt, Artificial Sequence
  mmSKRIPTE0006993_Il18bp_8
  gRNA
gggaggaacgcuacuaccug

SEQ ID NO: 136215 - RNA, 20 nt, Artificial Sequence
  mmSKRIPTE0006994_Il18bp_9
  gRNA
aguuccugaggacaguacca

SEQ ID NO: 136216 - RNA, 20 nt, Artificial Sequence
  mmSKRIPTE0006995_Efnb3_1
  gRNA
cgugcuuuauccucagaucg

SEQ ID NO: 136217 - RNA, 20 nt, Artificial Sequence
  mmSKRIPTE0006996_Efnb3_2
  gRNA
cccaugucccccacguagcg

SEQ ID NO: 136218 - RNA, 20 nt, Artificial Sequence
  mmSKRIPTE0006997_Efnb3_3
  gRNA
gagcuaagaauugcuguccg

SEQ ID NO: 136219 - RNA, 20 nt, Artificial Sequence
  mmSKRIPTE0006998_Efnb3_4
  gRNA
ccucuguccgccaaaaacgg

SEQ ID NO: 136220 - RNA, 20 nt, Artificial Sequence
  mmSKRIPTE0006999_Efnb3_5
  gRNA
cucggcgaauaagaggugag

SEQ ID NO: 136221 - RNA, 20 nt, Artificial Sequence
  mmSKRIPTE0007000_Efnb3_6
  gRNA
ggagggacaccauaccaggu

SEQ ID NO: 136222 - RNA, 20 nt, Artificial Sequence
  mmSKRIPTE0007001_Efnb3_7
  gRNA
gugacugggguuccacagcg

SEQ ID NO: 136223 - RNA, 20 nt, Artificial Sequence
  mmSKRIPTE0007002_Efnb3_8
  gRNA
gagcauuacugaauacccag

SEQ ID NO: 136224 - RNA, 20 nt, Artificial Sequence
  mmSKRIPTE0007003_Efnb3_9
  gRNA
augaaggugcuucugcgagu

SEQ ID NO: 136225 - RNA, 20 nt, Artificial Sequence
  mmSKRIPTE0007004_Ppp3cb_1
  gRNA
accgcgucgucaaaggugag

SEQ ID NO: 136226 - RNA, 20 nt, Artificial Sequence
  mmSKRIPTE0007005_Ppp3cb_2
  gRNA
cuagcuaggcguugucaccc

SEQ ID NO: 136227 - RNA, 20 nt, Artificial Sequence
  mmSKRIPTE0007006_Ppp3cb_3
  gRNA
ggacuugagcaaaauuaccg

SEQ ID NO: 136228 - RNA, 20 nt, Artificial Sequence
  mmSKRIPTE0007007_Ppp3cb_4
  gRNA
cgugcggcuaagggguuccg

SEQ ID NO: 136229 - RNA, 20 nt, Artificial Sequence
  mmSKRIPTE0007008_Ppp3cb_5
  gRNA
ggagccggaagcucuuaacg

SEQ ID NO: 136230 - RNA, 20 nt, Artificial Sequence
  mmSKRIPTE0007009_Ppp3cb_6
  gRNA
uaaucaaauaggauagccau

SEQ ID NO: 136231 - RNA, 20 nt, Artificial Sequence
  mmSKRIPTE0007010_Ppp3cb_7
  gRNA
ggacggcagaccuugcaaag

SEQ ID NO: 136232 - RNA, 20 nt, Artificial Sequence
  mmSKRIPTE0007011_Ppp3cb_8
  gRNA
cggcggcuaccagagccaag

SEQ ID NO: 136233 - RNA, 20 nt, Artificial Sequence
  mmSKRIPTE0007012_Ppp3cb_9
  gRNA
guugugccccaguccaucug

SEQ ID NO: 136234 - RNA, 20 nt, Artificial Sequence
  mmSKRIPTE0007013_Mapk14_1
  gRNA
cgugguccccgagauaaagu

SEQ ID NO: 136235 - RNA, 20 nt, Artificial Sequence
  mmSKRIPTE0007014_Mapk14_2
  gRNA
cagcagacgcaacucucggu

SEQ ID NO: 136236 - RNA, 20 nt, Artificial Sequence
  mmSKRIPTE0007015_Mapk14_3
  gRNA
ugaugagaugacaggcuacg

SEQ ID NO: 136237 - RNA, 20 nt, Artificial Sequence
  mmSKRIPTE0007016_Mapk14_4
  gRNA
agcagauaaugcgucugacg

SEQ ID NO: 136238 - RNA, 20 nt, Artificial Sequence
  mmSKRIPTE0007017_Mapk14_5
  gRNA
aguucuuugcaguuccagcg

SEQ ID NO: 136239 - RNA, 20 nt, Artificial Sequence
  mmSKRIPTE0007018_Mapk14_6
  gRNA
guuggguucaugccgcauga

SEQ ID NO: 136240 - RNA, 20 nt, Artificial Sequence
  mmSKRIPTE0007019_Mapk14_7
  gRNA
agaggauacaagcaccgaca

SEQ ID NO: 136241 - RNA, 20 nt, Artificial Sequence
  mmSKRIPTE0007020_Mapk14_8
  gRNA
aacugaucaauaucuaacgg

SEQ ID NO: 136242 - RNA, 20 nt, Artificial Sequence
  mmSKRIPTE0007021_Mapk14_9
  gRNA
uuuguaugcaauccugccgg

SEQ ID NO: 136243 - RNA, 20 nt, Artificial Sequence
  mmSKRIPTE0007022_Ezh2_1
  gRNA
guuucacguaaguacuccag

SEQ ID NO: 136244 - RNA, 20 nt, Artificial Sequence
  mmSKRIPTE0007023_Ezh2_2
  gRNA
cuccuaccuaggaacuaagu

SEQ ID NO: 136245 - RNA, 20 nt, Artificial Sequence
  mmSKRIPTE0007024_Ezh2_3
  gRNA
acugcuggcaccgucugaug

SEQ ID NO: 136246 - RNA, 20 nt, Artificial Sequence
  mmSKRIPTE0007025_Ezh2_4
  gRNA
agaguacauuauaggcaccg

SEQ ID NO: 136247 - RNA, 20 nt, Artificial Sequence
  mmSKRIPTE0007026_Ezh2_5
  gRNA
uaucagcacuguaaccuaag

SEQ ID NO: 136248 - RNA, 20 nt, Artificial Sequence
  mmSKRIPTE0007027_Ezh2_6
  gRNA
guuuauuuaguccagccggg

SEQ ID NO: 136249 - RNA, 20 nt, Artificial Sequence
  mmSKRIPTE0007028_Ezh2_7
  gRNA
uaccggccaaucuuagagug

SEQ ID NO: 136250 - RNA, 20 nt, Artificial Sequence
  mmSKRIPTE0007029_Ezh2_8
  gRNA
uuaaaccucagaccaccuga

SEQ ID NO: 136251 - RNA, 20 nt, Artificial Sequence
  mmSKRIPTE0007030_Ezh2_9
  gRNA
aucuucacaucaguacacgg

SEQ ID NO: 136252 - RNA, 20 nt, Artificial Sequence
  mmSKRIPTE0007031_Il17a_1
  gRNA
agauguugcccgucauaaag

SEQ ID NO: 136253 - RNA, 20 nt, Artificial Sequence
  mmSKRIPTE0007032_Il17a_2
  gRNA
gcagccuaaacagagacccg

SEQ ID NO: 136254 - RNA, 20 nt, Artificial Sequence
  mmSKRIPTE0007033_Il17a_3
  gRNA
gaacgguugagguagucuga

SEQ ID NO: 136255 - RNA, 20 nt, Artificial Sequence
  mmSKRIPTE0007034_Il17a_4
  gRNA
ugaccacuauaacagguuag

SEQ ID NO: 136256 - RNA, 20 nt, Artificial Sequence
  mmSKRIPTE0007035_Il17a_5
  gRNA
uggucacuuacgucaagagu

SEQ ID NO: 136257 - RNA, 20 nt, Artificial Sequence
  mmSKRIPTE0007036_Il17a_6
  gRNA
gagaaaaugaggaauccggg

SEQ ID NO: 136258 - RNA, 20 nt, Artificial Sequence
  mmSKRIPTE0007037_Il17a_7
  gRNA
cuuacguacuggagagucca

SEQ ID NO: 136259 - RNA, 20 nt, Artificial Sequence
  mmSKRIPTE0007038_Il17a_8
  gRNA
uaaguuugcugagaaacgug

SEQ ID NO: 136260 - RNA, 20 nt, Artificial Sequence
  mmSKRIPTE0007039_Il17a_9
  gRNA
gugcacuugugccucgugug

SEQ ID NO: 136261 - RNA, 20 nt, Artificial Sequence
  mmSKRIPTE0007040_Tnfsf11_1
  gRNA
ggaaauguaacuuacccgau

SEQ ID NO: 136262 - RNA, 20 nt, Artificial Sequence
  mmSKRIPTE0007041_Tnfsf11_2
  gRNA
ugaagguacucguagcuaag

SEQ ID NO: 136263 - RNA, 20 nt, Artificial Sequence
  mmSKRIPTE0007042_Tnfsf11_3
  gRNA
ucuguuaggauccaucuacg

SEQ ID NO: 136264 - RNA, 20 nt, Artificial Sequence
  mmSKRIPTE0007043_Tnfsf11_4
  gRNA
gccucgaucgugguaccaag

SEQ ID NO: 136265 - RNA, 20 nt, Artificial Sequence
  mmSKRIPTE0007044_Tnfsf11_5
  gRNA
gcugugaguuucauacaccg

SEQ ID NO: 136266 - RNA, 20 nt, Artificial Sequence
  mmSKRIPTE0007045_Tnfsf11_6
  gRNA
ucuaacaugacguuaagcaa

SEQ ID NO: 136267 - RNA, 20 nt, Artificial Sequence
  mmSKRIPTE0007046_Tnfsf11_7
  gRNA
guguuugagcuccugccggu

SEQ ID NO: 136268 - RNA, 20 nt, Artificial Sequence
  mmSKRIPTE0007047_Tnfsf11_8
  gRNA
uugacuuuacgacgucaggg

SEQ ID NO: 136269 - RNA, 20 nt, Artificial Sequence
  mmSKRIPTE0007048_Tnfsf11_9
  gRNA
aucagcugaagauagucugu

SEQ ID NO: 136270 - RNA, 20 nt, Artificial Sequence
  mmSKRIPTE0007049_Socs1_1
  gRNA
gcggaagugagugucgccag

SEQ ID NO: 136271 - RNA, 20 nt, Artificial Sequence
  mmSKRIPTE0007050_Socs1_2
  gRNA
gugcuaccauccuacucgag

SEQ ID NO: 136272 - RNA, 20 nt, Artificial Sequence
  mmSKRIPTE0007051_Socs1_3
  gRNA
gcugugucgccagcgcaucg

SEQ ID NO: 136273 - RNA, 20 nt, Artificial Sequence
  mmSKRIPTE0007052_Socs1_4
  gRNA
accgaggcucaagcuccggg

SEQ ID NO: 136274 - RNA, 20 nt, Artificial Sequence
  mmSKRIPTE0007053_Socs1_5
  gRNA
accucgcagacuguauggca

SEQ ID NO: 136275 - RNA, 20 nt, Artificial Sequence
  mmSKRIPTE0007054_Socs1_6
  gRNA
cgugccgcucucgcuccuug

SEQ ID NO: 136276 - RNA, 20 nt, Artificial Sequence
  mmSKRIPTE0007055_Socs1_7
  gRNA
cacaagcugcuacaaccagg

SEQ ID NO: 136277 - RNA, 20 nt, Artificial Sequence
  mmSKRIPTE0007056_Socs1_8
  gRNA
aaggguuccgcauacaggaa

SEQ ID NO: 136278 - RNA, 20 nt, Artificial Sequence
  mmSKRIPTE0007057_Socs1_9
  gRNA
cgagcugcuggagcacuacg

SEQ ID NO: 136279 - RNA, 20 nt, Artificial Sequence
  mmSKRIPTE0007058_Cd320_1
  gRNA
aaggagccgugaaacacgca

SEQ ID NO: 136280 - RNA, 20 nt, Artificial Sequence
  mmSKRIPTE0007059_Cd320_2
  gRNA
uggucucagaacaggccuag

SEQ ID NO: 136281 - RNA, 20 nt, Artificial Sequence
  mmSKRIPTE0007060_Cd320_3
  gRNA
cauuucuugagagcguccug

SEQ ID NO: 136282 - RNA, 20 nt, Artificial Sequence
  mmSKRIPTE0007061_Cd320_4
  gRNA
caaaagcgguguagaaacgg

SEQ ID NO: 136283 - RNA, 20 nt, Artificial Sequence
  mmSKRIPTE0007062_Cd320_5
  gRNA
ggacagcgcaggaauaaggg

SEQ ID NO: 136284 - RNA, 20 nt, Artificial Sequence
  mmSKRIPTE0007063_Cd320_6
  gRNA
cucauauugcuacgccuccg

SEQ ID NO: 136285 - RNA, 20 nt, Artificial Sequence
  mmSKRIPTE0007064_Cd320_7
  gRNA
gggcggcgcagccaauagug

SEQ ID NO: 136286 - RNA, 20 nt, Artificial Sequence
  mmSKRIPTE0007065_Cd320_8
  gRNA
gcaaggcaucaguagcugag

SEQ ID NO: 136287 - RNA, 20 nt, Artificial Sequence
  mmSKRIPTE0007066_Cd320_9
  gRNA
acauacagcgggagugucug

SEQ ID NO: 136288 - RNA, 20 nt, Artificial Sequence
  mmSKRIPTE0007067_Trim8_1
  gRNA
gcauaauucccgagccaccg

SEQ ID NO: 136289 - RNA, 20 nt, Artificial Sequence
  mmSKRIPTE0007068_Trim8_2
  gRNA
cauauaacaggccgccuccg

SEQ ID NO: 136290 - RNA, 20 nt, Artificial Sequence
  mmSKRIPTE0007069_Trim8_3
  gRNA
cacugcguguucugucgccg

SEQ ID NO: 136291 - RNA, 20 nt, Artificial Sequence
  mmSKRIPTE0007070_Trim8_4
  gRNA
guagccacugucgccgccaa

SEQ ID NO: 136292 - RNA, 20 nt, Artificial Sequence
  mmSKRIPTE0007071_Trim8_5
  gRNA
agcguaccccuguacccuug

SEQ ID NO: 136293 - RNA, 20 nt, Artificial Sequence
  mmSKRIPTE0007072_Trim8_6
  gRNA
cucucgugacauuagccuag

SEQ ID NO: 136294 - RNA, 20 nt, Artificial Sequence
  mmSKRIPTE0007073_Trim8_7
  gRNA
ggagcgcagaaguagcgacg

SEQ ID NO: 136295 - RNA, 20 nt, Artificial Sequence
  mmSKRIPTE0007074_Trim8_8
  gRNA
uuucaguaaugggaaacgcg

SEQ ID NO: 136296 - RNA, 20 nt, Artificial Sequence
  mmSKRIPTE0007075_Trim8_9
  gRNA
gaggcaguauagcuuaaccc

SEQ ID NO: 136297 - RNA, 20 nt, Artificial Sequence
  mmSKRIPTE0007076_Tnfsf8_1
  gRNA
aauuguagcgagauagacga

SEQ ID NO: 136298 - RNA, 20 nt, Artificial Sequence
  mmSKRIPTE0007077_Tnfsf8_2
  gRNA
ccacagaacgccuugccgcg

SEQ ID NO: 136299 - RNA, 20 nt, Artificial Sequence
  mmSKRIPTE0007078_Tnfsf8_3
  gRNA
uggauuagcacagugaucag

SEQ ID NO: 136300 - RNA, 20 nt, Artificial Sequence
  mmSKRIPTE0007079_Tnfsf8_4
  gRNA
uccuuucccaauaacuagag

SEQ ID NO: 136301 - RNA, 20 nt, Artificial Sequence
  mmSKRIPTE0007080_Tnfsf8_5
  gRNA
aacaaggcacaccagugcgg

SEQ ID NO: 136302 - RNA, 20 nt, Artificial Sequence
  mmSKRIPTE0007081_Tnfsf8_6
  gRNA
cugauacuucggacucaucu

SEQ ID NO: 136303 - RNA, 20 nt, Artificial Sequence
  mmSKRIPTE0007082_Tnfsf8_7
  gRNA
caacucagaagacgagacug

SEQ ID NO: 136304 - RNA, 20 nt, Artificial Sequence
  mmSKRIPTE0007083_Tnfsf8_8
  gRNA
acggauagcacauuaucaag

SEQ ID NO: 136305 - RNA, 20 nt, Artificial Sequence
  mmSKRIPTE0007084_Tnfsf8_9
  gRNA
gcagugcucaaaucauucug

SEQ ID NO: 136306 - RNA, 20 nt, Artificial Sequence
  mmSKRIPTE0007085_Fgr_1
  gRNA
uuauguguacuacguaggga

SEQ ID NO: 136307 - RNA, 20 nt, Artificial Sequence
  mmSKRIPTE0007086_Fgr_2
  gRNA
accagcaugaguauuccacu

SEQ ID NO: 136308 - RNA, 20 nt, Artificial Sequence
  mmSKRIPTE0007087_Fgr_3
  gRNA
ggagucaaacugggcccgug

SEQ ID NO: 136309 - RNA, 20 nt, Artificial Sequence
  mmSKRIPTE0007088_Fgr_4
  gRNA
cgggaaagcgagaccaccaa

SEQ ID NO: 136310 - RNA, 20 nt, Artificial Sequence
  mmSKRIPTE0007089_Fgr_5
  gRNA
ucacugucaaaucagacgug

SEQ ID NO: 136311 - RNA, 20 nt, Artificial Sequence
  mmSKRIPTE0007090_Fgr_6
  gRNA
uugcucuugccaaucccccg

SEQ ID NO: 136312 - RNA, 20 nt, Artificial Sequence
  mmSKRIPTE0007091_Fgr_7
  gRNA
auguauaucagccauagagu

SEQ ID NO: 136313 - RNA, 20 nt, Artificial Sequence
  mmSKRIPTE0007092_Fgr_8
  gRNA
gugacucacaucaggaucgg

SEQ ID NO: 136314 - RNA, 20 nt, Artificial Sequence
  mmSKRIPTE0007093_Fgr_9
  gRNA
ugaacaauacguaagugacu

SEQ ID NO: 136315 - RNA, 20 nt, Artificial Sequence
  mmSKRIPTE0007094_Cyp26b1_1
  gRNA
cauccaccgcaacaagcgca

SEQ ID NO: 136316 - RNA, 20 nt, Artificial Sequence
  mmSKRIPTE0007095_Cyp26b1_2
  gRNA
caguacagggaaccgcacag

SEQ ID NO: 136317 - RNA, 20 nt, Artificial Sequence
  mmSKRIPTE0007096_Cyp26b1_3
  gRNA
ccuggaggaagaccggacag

SEQ ID NO: 136318 - RNA, 20 nt, Artificial Sequence
  mmSKRIPTE0007097_Cyp26b1_4
  gRNA
gcugauucgugugaccggug

SEQ ID NO: 136319 - RNA, 20 nt, Artificial Sequence
  mmSKRIPTE0007098_Cyp26b1_5
  gRNA
gcaggccguauuaccccuag

SEQ ID NO: 136320 - RNA, 20 nt, Artificial Sequence
  mmSKRIPTE0007099_Cyp26b1_6
  gRNA
accagcuagugagcaccgag

SEQ ID NO: 136321 - RNA, 20 nt, Artificial Sequence
  mmSKRIPTE0007100_Cyp26b1_7
  gRNA
ggcugcgaagaucaacucca

SEQ ID NO: 136322 - RNA, 20 nt, Artificial Sequence
  mmSKRIPTE0007101_Cyp26b1_8
  gRNA
uccggguggccagcucgaag

SEQ ID NO: 136323 - RNA, 20 nt, Artificial Sequence
  mmSKRIPTE0007102_Cyp26b1_9
  gRNA
aaacacaggugguaaacuga

SEQ ID NO: 136324 - RNA, 20 nt, Artificial Sequence
  mmSKRIPTE0007103_Il27_1
  gRNA
agggccgaagugugguagcg

SEQ ID NO: 136325 - RNA, 20 nt, Artificial Sequence
  mmSKRIPTE0007104_Il27_2
  gRNA
cuugccguucacuuacagag

SEQ ID NO: 136326 - RNA, 20 nt, Artificial Sequence
  mmSKRIPTE0007105_Il27_3
  gRNA
aguuugcuuguagauccccg

SEQ ID NO: 136327 - RNA, 20 nt, Artificial Sequence
  mmSKRIPTE0007106_Il27_4
  gRNA
uuacacuagucucauucccg

SEQ ID NO: 136328 - RNA, 20 nt, Artificial Sequence
  mmSKRIPTE0007107_Il27_5
  gRNA
guuggccacguagacaggca

SEQ ID NO: 136329 - RNA, 20 nt, Artificial Sequence
  mmSKRIPTE0007108_Il27_6
  gRNA
uagcucguuugccuuagacc

SEQ ID NO: 136330 - RNA, 20 nt, Artificial Sequence
  mmSKRIPTE0007109_Il27_7
  gRNA
cuuagagucuuaacgggcga

SEQ ID NO: 136331 - RNA, 20 nt, Artificial Sequence
  mmSKRIPTE0007110_Il27_8
  gRNA
cgcacucuaccugaaagcgg

SEQ ID NO: 136332 - RNA, 20 nt, Artificial Sequence
  mmSKRIPTE0007111_Il27_9
  gRNA
gcaaucgagauucagccuga

SEQ ID NO: 136333 - RNA, 20 nt, Artificial Sequence
  mmSKRIPTE0007112_Hras_1
  gRNA
caucuauuagccgucucaag

SEQ ID NO: 136334 - RNA, 20 nt, Artificial Sequence
  mmSKRIPTE0007113_Hras_2
  gRNA
guucaacuugagacguacug

SEQ ID NO: 136335 - RNA, 20 nt, Artificial Sequence
  mmSKRIPTE0007114_Hras_3
  gRNA
caggaccacucucaucgggu

SEQ ID NO: 136336 - RNA, 20 nt, Artificial Sequence
  mmSKRIPTE0007115_Hras_4
  gRNA
gggaagggcuguauaguccg

SEQ ID NO: 136337 - RNA, 20 nt, Artificial Sequence
  mmSKRIPTE0007116_Hras_5
  gRNA
gcgcauguacuggucccgca

SEQ ID NO: 136338 - RNA, 20 nt, Artificial Sequence
  mmSKRIPTE0007117_Hras_6
  gRNA
ggugccacaggugaucaacu

SEQ ID NO: 136339 - RNA, 20 nt, Artificial Sequence
  mmSKRIPTE0007118_Hras_7
  gRNA
gaucauacucguccacaaag

SEQ ID NO: 136340 - RNA, 20 nt, Artificial Sequence
  mmSKRIPTE0007119_Hras_8
  gRNA
uguaagucucccagaccgca

SEQ ID NO: 136341 - RNA, 20 nt, Artificial Sequence
  mmSKRIPTE0007120_Hras_9
  gRNA
ggugugaccugaucuaggca

SEQ ID NO: 136342 - RNA, 20 nt, Artificial Sequence
  mmSKRIPTE0007121_Lig4_1
  gRNA
aauuagacguccuaauugug

SEQ ID NO: 136343 - RNA, 20 nt, Artificial Sequence
  mmSKRIPTE0007122_Lig4_2
  gRNA
gacacgauuucuucacccgg

SEQ ID NO: 136344 - RNA, 20 nt, Artificial Sequence
  mmSKRIPTE0007123_Lig4_3
  gRNA
uaaugucgaaacauacugag

SEQ ID NO: 136345 - RNA, 20 nt, Artificial Sequence
  mmSKRIPTE0007124_Lig4_4
  gRNA
cacaugugaaucauaaagcg

SEQ ID NO: 136346 - RNA, 20 nt, Artificial Sequence
  mmSKRIPTE0007125_Lig4_5
  gRNA
auuaaaccagaguacgucag

SEQ ID NO: 136347 - RNA, 20 nt, Artificial Sequence
  mmSKRIPTE0007126_Lig4_6
  gRNA
uggagauucaccaaacuggu

SEQ ID NO: 136348 - RNA, 20 nt, Artificial Sequence
  mmSKRIPTE0007127_Lig4_7
  gRNA
gugguaaagucgaugaccac

SEQ ID NO: 136349 - RNA, 20 nt, Artificial Sequence
  mmSKRIPTE0007128_Lig4_8
  gRNA
uugcugaacuuaccacgaga

SEQ ID NO: 136350 - RNA, 20 nt, Artificial Sequence
  mmSKRIPTE0007129_Lig4_9
  gRNA
aggccaucaucucaccguca

SEQ ID NO: 136351 - RNA, 20 nt, Artificial Sequence
  mmSKRIPTE0007130_Hmox1_1
  gRNA
ggacugaacuguaucaacgg

SEQ ID NO: 136352 - RNA, 20 nt, Artificial Sequence
  mmSKRIPTE0007131_Hmox1_2
  gRNA
gccuguuaaugauacucacg

SEQ ID NO: 136353 - RNA, 20 nt, Artificial Sequence
  mmSKRIPTE0007132_Hmox1_3
  gRNA
agauggcgucacuucgucag

SEQ ID NO: 136354 - RNA, 20 nt, Artificial Sequence
  mmSKRIPTE0007133_Hmox1_4
  gRNA
cuuaugccaauaauuuaacg

SEQ ID NO: 136355 - RNA, 20 nt, Artificial Sequence
  mmSKRIPTE0007134_Hmox1_5
  gRNA
gcgccagcccuuuaaguacg

SEQ ID NO: 136356 - RNA, 20 nt, Artificial Sequence
  mmSKRIPTE0007135_Hmox1_6
  gRNA
aaggggaagaagacucaucg

SEQ ID NO: 136357 - RNA, 20 nt, Artificial Sequence
  mmSKRIPTE0007136_Hmox1_7
  gRNA
ccccugcagagacaccccga

SEQ ID NO: 136358 - RNA, 20 nt, Artificial Sequence
  mmSKRIPTE0007137_Hmox1_8
  gRNA
gcuccgggcuaugcucgaga

SEQ ID NO: 136359 - RNA, 20 nt, Artificial Sequence
  mmSKRIPTE0007138_Hmox1_9
  gRNA
ggggcugucgauguucggga

SEQ ID NO: 136360 - RNA, 20 nt, Artificial Sequence
  mmSKRIPTE0007139_Icam1_1
  gRNA
acguggaugguggagcaccg

SEQ ID NO: 136361 - RNA, 20 nt, Artificial Sequence
  mmSKRIPTE0007140_Icam1_2
  gRNA
ccaucaccguguauugugag

SEQ ID NO: 136362 - RNA, 20 nt, Artificial Sequence
  mmSKRIPTE0007141_Icam1_3
  gRNA
ggaaacgcugcaaggaaacg

SEQ ID NO: 136363 - RNA, 20 nt, Artificial Sequence
  mmSKRIPTE0007142_Icam1_4
  gRNA
agggcuucgguauuuccggg

SEQ ID NO: 136364 - RNA, 20 nt, Artificial Sequence
  mmSKRIPTE0007143_Icam1_5
  gRNA
caguccgucucguccagccg

SEQ ID NO: 136365 - RNA, 20 nt, Artificial Sequence
  mmSKRIPTE0007144_Icam1_6
  gRNA
guacagucaucacaucaguu

SEQ ID NO: 136366 - RNA, 20 nt, Artificial Sequence
  mmSKRIPTE0007145_Icam1_7
  gRNA
cagugugaauuggaccugcg

SEQ ID NO: 136367 - RNA, 20 nt, Artificial Sequence
  mmSKRIPTE0007146_Icam1_8
  gRNA
gagccuccggacuuucggug

SEQ ID NO: 136368 - RNA, 20 nt, Artificial Sequence
  mmSKRIPTE0007147_Icam1_9
  gRNA
uaagaugaccugcagacgga

SEQ ID NO: 136369 - RNA, 20 nt, Artificial Sequence
  mmSKRIPTE0007148_Efnb1_1
  gRNA
cucccauuggacguugcugu

SEQ ID NO: 136370 - RNA, 20 nt, Artificial Sequence
  mmSKRIPTE0007149_Efnb1_2
  gRNA
gucgauuugauagcuccacc

SEQ ID NO: 136371 - RNA, 20 nt, Artificial Sequence
  mmSKRIPTE0007150_Efnb1_3
  gRNA
cagaggcgucaaucccagga

SEQ ID NO: 136372 - RNA, 20 nt, Artificial Sequence
  mmSKRIPTE0007151_Efnb1_4
  gRNA
ucuucagggagacccgaucg

SEQ ID NO: 136373 - RNA, 20 nt, Artificial Sequence
  mmSKRIPTE0007152_Efnb1_5
  gRNA
acacucgggcucaaucgccg

SEQ ID NO: 136374 - RNA, 20 nt, Artificial Sequence
  mmSKRIPTE0007153_Efnb1_6
  gRNA
ggcuaggguacugagcgaga

SEQ ID NO: 136375 - RNA, 20 nt, Artificial Sequence
  mmSKRIPTE0007154_Efnb1_7
  gRNA
auggcacgaaucugaaugug

SEQ ID NO: 136376 - RNA, 20 nt, Artificial Sequence
  mmSKRIPTE0007155_Efnb1_8
  gRNA
auuaauuaccgugagaguga

SEQ ID NO: 136377 - RNA, 20 nt, Artificial Sequence
  mmSKRIPTE0007156_Efnb1_9
  gRNA
agagccgagcggaauccggc

SEQ ID NO: 136378 - RNA, 20 nt, Artificial Sequence
  mmSKRIPTE0007157_Il1r1_1
  gRNA
guauguccuauacguuccgg

SEQ ID NO: 136379 - RNA, 20 nt, Artificial Sequence
  mmSKRIPTE0007158_Il1r1_2
  gRNA
guucuaaggccugauaggaa

SEQ ID NO: 136380 - RNA, 20 nt, Artificial Sequence
  mmSKRIPTE0007159_Il1r1_3
  gRNA
caguugugcguucaagaccg

SEQ ID NO: 136381 - RNA, 20 nt, Artificial Sequence
  mmSKRIPTE0007160_Il1r1_4
  gRNA
gacuuccauccccggcaaug

SEQ ID NO: 136382 - RNA, 20 nt, Artificial Sequence
  mmSKRIPTE0007161_Il1r1_5
  gRNA
aaacagagcucaauguacca

SEQ ID NO: 136383 - RNA, 20 nt, Artificial Sequence
  mmSKRIPTE0007162_Il1r1_6
  gRNA
cuccggugucacaagaucgg

SEQ ID NO: 136384 - RNA, 20 nt, Artificial Sequence
  mmSKRIPTE0007163_Il1r1_7
  gRNA
gcagcaacacacuuaccacu

SEQ ID NO: 136385 - RNA, 20 nt, Artificial Sequence
  mmSKRIPTE0007164_Il1r1_8
  gRNA
guuccugaaauagggucgca

SEQ ID NO: 136386 - RNA, 20 nt, Artificial Sequence
  mmSKRIPTE0007165_Il1r1_9
  gRNA
acuaacucaguacucguggg

SEQ ID NO: 136387 - RNA, 20 nt, Artificial Sequence
  mmSKRIPTE0007166_Casp8_1
  gRNA
aggagccuguacaauccgau

SEQ ID NO: 136388 - RNA, 20 nt, Artificial Sequence
  mmSKRIPTE0007167_Casp8_2
  gRNA
cuuccuagacugcaaccgag

SEQ ID NO: 136389 - RNA, 20 nt, Artificial Sequence
  mmSKRIPTE0007168_Casp8_3
  gRNA
agacugcgggcuaaauguag

SEQ ID NO: 136390 - RNA, 20 nt, Artificial Sequence
  mmSKRIPTE0007169_Casp8_4
  gRNA
gcuuucuagguuucggagug

SEQ ID NO: 136391 - RNA, 20 nt, Artificial Sequence
  mmSKRIPTE0007170_Casp8_5
  gRNA
uccauucacaggaucucggu

SEQ ID NO: 136392 - RNA, 20 nt, Artificial Sequence
  mmSKRIPTE0007171_Casp8_6
  gRNA
cugccagauaagccaauaag

SEQ ID NO: 136393 - RNA, 20 nt, Artificial Sequence
  mmSKRIPTE0007172_Casp8_7
  gRNA
caagacagugagucacgggu

SEQ ID NO: 136394 - RNA, 20 nt, Artificial Sequence
  mmSKRIPTE0007173_Casp8_8
  gRNA
aagaugcuaaugaucaagug

SEQ ID NO: 136395 - RNA, 20 nt, Artificial Sequence
  mmSKRIPTE0007174_Casp8_9
  gRNA
gucacacuuaggacaaccua

SEQ ID NO: 136396 - RNA, 20 nt, Artificial Sequence
  mmSKRIPTE0007175_Rab7b_1
  gRNA
gugacaauuaugguacaaca

SEQ ID NO: 136397 - RNA, 20 nt, Artificial Sequence
  mmSKRIPTE0007176_Rab7b_2
  gRNA
agacggaaugcccagcaacg

SEQ ID NO: 136398 - RNA, 20 nt, Artificial Sequence
  mmSKRIPTE0007177_Rab7b_3
  gRNA
aacaaguacuagaagcucgg

SEQ ID NO: 136399 - RNA, 20 nt, Artificial Sequence
  mmSKRIPTE0007178_Rab7b_4
  gRNA
cuucagugaccgaguauggg

SEQ ID NO: 136400 - RNA, 20 nt, Artificial Sequence
  mmSKRIPTE0007179_Rab7b_5
  gRNA
agacgcccgugauuucucug

SEQ ID NO: 136401 - RNA, 20 nt, Artificial Sequence
  mmSKRIPTE0007180_Rab7b_6
  gRNA
aagugugcccuuccgcaccc

SEQ ID NO: 136402 - RNA, 20 nt, Artificial Sequence
  mmSKRIPTE0007181_Rab7b_7
  gRNA
agcugucaucgggaguccgg

SEQ ID NO: 136403 - RNA, 20 nt, Artificial Sequence
  mmSKRIPTE0007182_Rab7b_8
  gRNA
gaaucuuuguuuccucagcg

SEQ ID NO: 136404 - RNA, 20 nt, Artificial Sequence
  mmSKRIPTE0007183_Rab7b_9
  gRNA
ggugugccagugaagagacg

SEQ ID NO: 136405 - RNA, 20 nt, Artificial Sequence
  mmSKRIPTE0007184_Dapk3_1
  gRNA
cucauaguucacgaucucgg

SEQ ID NO: 136406 - RNA, 20 nt, Artificial Sequence
  mmSKRIPTE0007185_Dapk3_2
  gRNA
gggaccgcuacuaaugcacu

SEQ ID NO: 136407 - RNA, 20 nt, Artificial Sequence
  mmSKRIPTE0007186_Dapk3_3
  gRNA
acuaagacuguaccugcuag

SEQ ID NO: 136408 - RNA, 20 nt, Artificial Sequence
  mmSKRIPTE0007187_Dapk3_4
  gRNA
cggauccgacuucucccaag

SEQ ID NO: 136409 - RNA, 20 nt, Artificial Sequence
  mmSKRIPTE0007188_Dapk3_5
  gRNA
aguucacauagagacgugca

SEQ ID NO: 136410 - RNA, 20 nt, Artificial Sequence
  mmSKRIPTE0007189_Dapk3_6
  gRNA
ugggaaccugaagucuggcg

SEQ ID NO: 136411 - RNA, 20 nt, Artificial Sequence
  mmSKRIPTE0007190_Dapk3_7
  gRNA
cccaaguaggcggcccaugg

SEQ ID NO: 136412 - RNA, 20 nt, Artificial Sequence
  mmSKRIPTE0007191_Dapk3_8
  gRNA
cauguccacauucaggcaag

SEQ ID NO: 136413 - RNA, 20 nt, Artificial Sequence
  mmSKRIPTE0007192_Dapk3_9
  gRNA
ccugugguacaaacgcauag

SEQ ID NO: 136414 - RNA, 20 nt, Artificial Sequence
  mmSKRIPTE0007193_Havcr2_1
  gRNA
acuaacgugguaaucacugg

SEQ ID NO: 136415 - RNA, 20 nt, Artificial Sequence
  mmSKRIPTE0007194_Havcr2_2
  gRNA
guaucuggcgaauguccaug

SEQ ID NO: 136416 - RNA, 20 nt, Artificial Sequence
  mmSKRIPTE0007195_Havcr2_3
  gRNA
gagaugaggcucggacagug

SEQ ID NO: 136417 - RNA, 20 nt, Artificial Sequence
  mmSKRIPTE0007196_Havcr2_4
  gRNA
augugacucuggaugaccau

SEQ ID NO: 136418 - RNA, 20 nt, Artificial Sequence
  mmSKRIPTE0007197_Havcr2_5
  gRNA
ccggugacugggacauacga

SEQ ID NO: 136419 - RNA, 20 nt, Artificial Sequence
  mmSKRIPTE0007198_Havcr2_6
  gRNA
gcugacggacaaugauaaca

SEQ ID NO: 136420 - RNA, 20 nt, Artificial Sequence
  mmSKRIPTE0007199_Havcr2_7
  gRNA
uuguuacagccuuauuacac

SEQ ID NO: 136421 - RNA, 20 nt, Artificial Sequence
  mmSKRIPTE0007200_Havcr2_8
  gRNA
gaggaagcuaaauguaccag

SEQ ID NO: 136422 - RNA, 20 nt, Artificial Sequence
  mmSKRIPTE0007201_Havcr2_9
  gRNA
uuacacucuaucuacaccug

SEQ ID NO: 136423 - RNA, 20 nt, Artificial Sequence
  mmSKRIPTE0007202_Siva1_1
  gRNA
cugugcagcuaugccgacga

SEQ ID NO: 136424 - RNA, 20 nt, Artificial Sequence
  mmSKRIPTE0007203_Siva1_2
  gRNA
uaacucuccaaaccgcaaag

SEQ ID NO: 136425 - RNA, 20 nt, Artificial Sequence
  mmSKRIPTE0007204_Siva1_3
  gRNA
gcucccggagaaauccgagu

SEQ ID NO: 136426 - RNA, 20 nt, Artificial Sequence
  mmSKRIPTE0007205_Siva1_4
  gRNA
uaaugggaggagcaccggag

SEQ ID NO: 136427 - RNA, 20 nt, Artificial Sequence
  mmSKRIPTE0007206_Siva1_5
  gRNA
cggugaguguggacuuccgu

SEQ ID NO: 136428 - RNA, 20 nt, Artificial Sequence
  mmSKRIPTE0007207_Siva1_6
  gRNA
ccugugaggagaaaacaccg

SEQ ID NO: 136429 - RNA, 20 nt, Artificial Sequence
  mmSKRIPTE0007208_Siva1_7
  gRNA
ucuucccuagguguaacagc

SEQ ID NO: 136430 - RNA, 20 nt, Artificial Sequence
  mmSKRIPTE0007209_Siva1_8
  gRNA
cgagcggacuagccuagcgc

SEQ ID NO: 136431 - RNA, 20 nt, Artificial Sequence
  mmSKRIPTE0007210_Siva1_9
  gRNA
uagacuaaaggcucacgaug

SEQ ID NO: 136432 - RNA, 20 nt, Artificial Sequence
  mmSKRIPTE0007211_Il6st_1
  gRNA
gaauuuccaguuguccagcg

SEQ ID NO: 136433 - RNA, 20 nt, Artificial Sequence
  mmSKRIPTE0007212_Il6st_2
  gRNA
gcugaggugcaucaacagug

SEQ ID NO: 136434 - RNA, 20 nt, Artificial Sequence
  mmSKRIPTE0007213_Il6st_3
  gRNA
uaccuauagauucaguggug

SEQ ID NO: 136435 - RNA, 20 nt, Artificial Sequence
  mmSKRIPTE0007214_Il6st_4
  gRNA
ccucagcagcugucucacag

SEQ ID NO: 136436 - RNA, 20 nt, Artificial Sequence
  mmSKRIPTE0007215_Il6st_5
  gRNA
cugcuagagacgcgacauag

SEQ ID NO: 136437 - RNA, 20 nt, Artificial Sequence
  mmSKRIPTE0007216_Il6st_6
  gRNA
cauaucuuacagaaccagcg

SEQ ID NO: 136438 - RNA, 20 nt, Artificial Sequence
  mmSKRIPTE0007217_Il6st_7
  gRNA
ccugcaagaugucagcacca

SEQ ID NO: 136439 - RNA, 20 nt, Artificial Sequence
  mmSKRIPTE0007218_Il6st_8
  gRNA
gcgccaugucaucugaugug

SEQ ID NO: 136440 - RNA, 20 nt, Artificial Sequence
  mmSKRIPTE0007219_Il6st_9
  gRNA
uugacacuucaauguucacg

SEQ ID NO: 136441 - RNA, 20 nt, Artificial Sequence
  mmSKRIPTE0007220_Vegfb_1
  gRNA
uccgcccuacaaccgcccag

SEQ ID NO: 136442 - RNA, 20 nt, Artificial Sequence
  mmSKRIPTE0007221_Vegfb_2
  gRNA
acuagcgggccuucgccaag

SEQ ID NO: 136443 - RNA, 20 nt, Artificial Sequence
  mmSKRIPTE0007222_Vegfb_3
  gRNA
ugcuccaggacauaaccuug

SEQ ID NO: 136444 - RNA, 20 nt, Artificial Sequence
  mmSKRIPTE0007223_Vegfb_4
  gRNA
aaagcccaagccuuagcgcu

SEQ ID NO: 136445 - RNA, 20 nt, Artificial Sequence
  mmSKRIPTE0007224_Vegfb_5
  gRNA
cgugcauaaacgucuaucca

SEQ ID NO: 136446 - RNA, 20 nt, Artificial Sequence
  mmSKRIPTE0007225_Vegfb_6
  gRNA
ugggcgauaccauuccauag

SEQ ID NO: 136447 - RNA, 20 nt, Artificial Sequence
  mmSKRIPTE0007226_Vegfb_7
  gRNA
gaggagaagcgacacgucug

SEQ ID NO: 136448 - RNA, 20 nt, Artificial Sequence
  mmSKRIPTE0007227_Vegfb_8
  gRNA
gcgaaccuccucagucuggg

SEQ ID NO: 136449 - RNA, 20 nt, Artificial Sequence
  mmSKRIPTE0007228_Vegfb_9
  gRNA
cgccugcuaccucugucgag

SEQ ID NO: 136450 - RNA, 20 nt, Artificial Sequence
  mmSKRIPTE0007229_Fcnb_1
  gRNA
acgcucuaaccacccagggu

SEQ ID NO: 136451 - RNA, 20 nt, Artificial Sequence
  mmSKRIPTE0007230_Fcnb_2
  gRNA
acuguccggaaaggacaccu

SEQ ID NO: 136452 - RNA, 20 nt, Artificial Sequence
  mmSKRIPTE0007231_Fcnb_3
  gRNA
gcacugguuagggucaacug

SEQ ID NO: 136453 - RNA, 20 nt, Artificial Sequence
  mmSKRIPTE0007232_Fcnb_4
  gRNA
uccaugcccagacauaccua

SEQ ID NO: 136454 - RNA, 20 nt, Artificial Sequence
  mmSKRIPTE0007233_Fcnb_5
  gRNA
uggcagaccccauacaccug

SEQ ID NO: 136455 - RNA, 20 nt, Artificial Sequence
  mmSKRIPTE0007234_Fcnb_6
  gRNA
ucauuggagacaguagucag

SEQ ID NO: 136456 - RNA, 20 nt, Artificial Sequence
  mmSKRIPTE0007235_Fcnb_7
  gRNA
ucucugcaaagcuauagagg

SEQ ID NO: 136457 - RNA, 20 nt, Artificial Sequence
  mmSKRIPTE0007236_Fcnb_8
  gRNA
aacuuggaauucaccggggu

SEQ ID NO: 136458 - RNA, 20 nt, Artificial Sequence
  mmSKRIPTE0007237_Fcnb_9
  gRNA
agcaacuccuugcagguccg

SEQ ID NO: 136459 - RNA, 20 nt, Artificial Sequence
  mmSKRIPTE0007238_Vav3_1
  gRNA
ggauacugcguugaacaaca

SEQ ID NO: 136460 - RNA, 20 nt, Artificial Sequence
  mmSKRIPTE0007239_Vav3_2
  gRNA
aaccaggauagcaucuugcg

SEQ ID NO: 136461 - RNA, 20 nt, Artificial Sequence
  mmSKRIPTE0007240_Vav3_3
  gRNA
aucuacugguuuagguaccu

SEQ ID NO: 136462 - RNA, 20 nt, Artificial Sequence
  mmSKRIPTE0007241_Vav3_4
  gRNA
ggaucccaagaugaacaaca

SEQ ID NO: 136463 - RNA, 20 nt, Artificial Sequence
  mmSKRIPTE0007242_Vav3_5
  gRNA
aauaccguacucuuagcucg

SEQ ID NO: 136464 - RNA, 20 nt, Artificial Sequence
  mmSKRIPTE0007243_Vav3_6
  gRNA
uggauugagucaauacaaug

SEQ ID NO: 136465 - RNA, 20 nt, Artificial Sequence
  mmSKRIPTE0007244_Vav3_7
  gRNA
uggaaugaaccugaucacac

SEQ ID NO: 136466 - RNA, 20 nt, Artificial Sequence
  mmSKRIPTE0007245_Vav3_8
  gRNA
acagaagucguaccgagcga

SEQ ID NO: 136467 - RNA, 20 nt, Artificial Sequence
  mmSKRIPTE0007246_Vav3_9
  gRNA
gagaaguccuagcccccaug

SEQ ID NO: 136468 - RNA, 20 nt, Artificial Sequence
  mmSKRIPTE0007247_Cxcl2_1
  gRNA
ggggaucauuauaaggcacg

SEQ ID NO: 136469 - RNA, 20 nt, Artificial Sequence
  mmSKRIPTE0007248_Cxcl2_2
  gRNA
acgaugucuggaaaagcccg

SEQ ID NO: 136470 - RNA, 20 nt, Artificial Sequence
  mmSKRIPTE0007249_Cxcl2_3
  gRNA
uagauagaaccaacuagcgc

SEQ ID NO: 136471 - RNA, 20 nt, Artificial Sequence
  mmSKRIPTE0007250_Cxcl2_4
  gRNA
uccugacaccuucaauacga

SEQ ID NO: 136472 - RNA, 20 nt, Artificial Sequence
  mmSKRIPTE0007251_Cxcl2_5
  gRNA
cagcgaccauccauuaagga

SEQ ID NO: 136473 - RNA, 20 nt, Artificial Sequence
  mmSKRIPTE0007252_Cxcl2_6
  gRNA
gcaaggcacugugccuuacg

SEQ ID NO: 136474 - RNA, 20 nt, Artificial Sequence
  mmSKRIPTE0007253_Cxcl2_7
  gRNA
agaaaaugguugcuguuagu

SEQ ID NO: 136475 - RNA, 20 nt, Artificial Sequence
  mmSKRIPTE0007254_Cxcl2_8
  gRNA
agguacgauccaggcuuccc

SEQ ID NO: 136476 - RNA, 20 nt, Artificial Sequence
  mmSKRIPTE0007255_Cxcl2_9
  gRNA
aagugaacucucagacagcg

SEQ ID NO: 136477 - RNA, 20 nt, Artificial Sequence
  mmSKRIPTE0007256_Pla2g1b_1
  gRNA
acuccgaacugcuuuacccg

SEQ ID NO: 136478 - RNA, 20 nt, Artificial Sequence
  mmSKRIPTE0007257_Pla2g1b_2
  gRNA
aucuggaaaccauccccuug

SEQ ID NO: 136479 - RNA, 20 nt, Artificial Sequence
  mmSKRIPTE0007258_Pla2g1b_3
  gRNA
aagaauacacacgacgcuca

SEQ ID NO: 136480 - RNA, 20 nt, Artificial Sequence
  mmSKRIPTE0007259_Pla2g1b_4
  gRNA
cuaucgggggaacaacacag

SEQ ID NO: 136481 - RNA, 20 nt, Artificial Sequence
  mmSKRIPTE0007260_Pla2g1b_5
  gRNA
acugggauugaauaaaggcg

SEQ ID NO: 136482 - RNA, 20 nt, Artificial Sequence
  mmSKRIPTE0007261_Pla2g1b_6
  gRNA
auuccagcgugaccaguggg

SEQ ID NO: 136483 - RNA, 20 nt, Artificial Sequence
  mmSKRIPTE0007262_Pla2g1b_7
  gRNA
ccuucaggggaucacucccg

SEQ ID NO: 136484 - RNA, 20 nt, Artificial Sequence
  mmSKRIPTE0007263_Pla2g1b_8
  gRNA
ggaacugccacacagcccga

SEQ ID NO: 136485 - RNA, 20 nt, Artificial Sequence
  mmSKRIPTE0007264_Pla2g1b_9
  gRNA
caaucacaucucgucucgag

SEQ ID NO: 136486 - RNA, 20 nt, Artificial Sequence
  mmSKRIPTE0007265_Rab35_1
  gRNA
acucggcuaggacacgaggu

SEQ ID NO: 136487 - RNA, 20 nt, Artificial Sequence
  mmSKRIPTE0007266_Rab35_2
  gRNA
uggcccuacagguauuaucg

SEQ ID NO: 136488 - RNA, 20 nt, Artificial Sequence
  mmSKRIPTE0007267_Rab35_3
  gRNA
cccagcucaccggaaccaug

SEQ ID NO: 136489 - RNA, 20 nt, Artificial Sequence
  mmSKRIPTE0007268_Rab35_4
  gRNA
cuacaucaccacaaucggag

SEQ ID NO: 136490 - RNA, 20 nt, Artificial Sequence
  mmSKRIPTE0007269_Rab35_5
  gRNA
gcagcaacaacagaacgaug

SEQ ID NO: 136491 - RNA, 20 nt, Artificial Sequence
  mmSKRIPTE0007270_Rab35_6
  gRNA
aaaaauacugagcccgaugu

SEQ ID NO: 136492 - RNA, 20 nt, Artificial Sequence
  mmSKRIPTE0007271_Rab35_7
  gRNA
ugccaaggagaacgucaaug

SEQ ID NO: 136493 - RNA, 20 nt, Artificial Sequence
  mmSKRIPTE0007272_Rab35_8
  gRNA
guaaugcaaaaaccaccagu

SEQ ID NO: 136494 - RNA, 20 nt, Artificial Sequence
  mmSKRIPTE0007273_Rab35_9
  gRNA
aguugcgugacauugcugaa

SEQ ID NO: 136495 - RNA, 20 nt, Artificial Sequence
  mmSKRIPTE0007274_Cxcl12_1
  gRNA
ucucugacgcgcauccccug

SEQ ID NO: 136496 - RNA, 20 nt, Artificial Sequence
  mmSKRIPTE0007275_Cxcl12_2
  gRNA
gacuuuccaguagacccccg

SEQ ID NO: 136497 - RNA, 20 nt, Artificial Sequence
  mmSKRIPTE0007276_Cxcl12_3
  gRNA
ucaacacaagauccggcaga

SEQ ID NO: 136498 - RNA, 20 nt, Artificial Sequence
  mmSKRIPTE0007277_Cxcl12_4
  gRNA
guggaccgagagugaaagug

SEQ ID NO: 136499 - RNA, 20 nt, Artificial Sequence
  mmSKRIPTE0007278_Cxcl12_5
  gRNA
accgucacugaugcagagcg

SEQ ID NO: 136500 - RNA, 20 nt, Artificial Sequence
  mmSKRIPTE0007279_Cxcl12_6
  gRNA
ucgcggagaaagaacucggu

SEQ ID NO: 136501 - RNA, 20 nt, Artificial Sequence
  mmSKRIPTE0007280_Cxcl12_7
  gRNA
auggcauaucaguguccccg

SEQ ID NO: 136502 - RNA, 20 nt, Artificial Sequence
  mmSKRIPTE0007281_Cxcl12_8
  gRNA
auugguccgucaggcuacag

SEQ ID NO: 136503 - RNA, 20 nt, Artificial Sequence
  mmSKRIPTE0007282_Cxcl12_9
  gRNA
guucacuacaagcgaacuug

SEQ ID NO: 136504 - RNA, 20 nt, Artificial Sequence
  mmSKRIPTE0007283_Cd151_1
  gRNA
gcacacggcaccaugccgag

SEQ ID NO: 136505 - RNA, 20 nt, Artificial Sequence
  mmSKRIPTE0007284_Cd151_2
  gRNA
cugaguacaccacuacacgu

SEQ ID NO: 136506 - RNA, 20 nt, Artificial Sequence
  mmSKRIPTE0007285_Cd151_3
  gRNA
agagacaauaagaugccggu

SEQ ID NO: 136507 - RNA, 20 nt, Artificial Sequence
  mmSKRIPTE0007286_Cd151_4
  gRNA
guacagaccucggcugacgc

SEQ ID NO: 136508 - RNA, 20 nt, Artificial Sequence
  mmSKRIPTE0007287_Cd151_5
  gRNA
agcucuccucccgacuguag

SEQ ID NO: 136509 - RNA, 20 nt, Artificial Sequence
  mmSKRIPTE0007288_Cd151_6
  gRNA
gaguggcacauucacauaug

SEQ ID NO: 136510 - RNA, 20 nt, Artificial Sequence
  mmSKRIPTE0007289_Cd151_7
  gRNA
auccugggccuagaggaacg

SEQ ID NO: 136511 - RNA, 20 nt, Artificial Sequence
  mmSKRIPTE0007290_Cd151_8
  gRNA
cgaguggauccgcucuggug

SEQ ID NO: 136512 - RNA, 20 nt, Artificial Sequence
  mmSKRIPTE0007291_Cd151_9
  gRNA
ccuguuacgcuuggucagug

SEQ ID NO: 136513 - RNA, 20 nt, Artificial Sequence
  mmSKRIPTE0007292_Cdc37_1
  gRNA
ugacaucgcgcacugcacug

SEQ ID NO: 136514 - RNA, 20 nt, Artificial Sequence
  mmSKRIPTE0007293_Cdc37_2
  gRNA
accugggcaugagauauaug

SEQ ID NO: 136515 - RNA, 20 nt, Artificial Sequence
  mmSKRIPTE0007294_Cdc37_3
  gRNA
uggcgucgcuaagugcauca

SEQ ID NO: 136516 - RNA, 20 nt, Artificial Sequence
  mmSKRIPTE0007295_Cdc37_4
  gRNA
auaagauguuccccuagcag

SEQ ID NO: 136517 - RNA, 20 nt, Artificial Sequence
  mmSKRIPTE0007296_Cdc37_5
  gRNA
gggauucguagaccuccacg

SEQ ID NO: 136518 - RNA, 20 nt, Artificial Sequence
  mmSKRIPTE0007297_Cdc37_6
  gRNA
ucggcggcauuggcaaccgg

SEQ ID NO: 136519 - RNA, 20 nt, Artificial Sequence
  mmSKRIPTE0007298_Cdc37_7
  gRNA
auacccucugaucugcccga

SEQ ID NO: 136520 - RNA, 20 nt, Artificial Sequence
  mmSKRIPTE0007299_Cdc37_8
  gRNA
accagcggauggguagcacg

SEQ ID NO: 136521 - RNA, 20 nt, Artificial Sequence
  mmSKRIPTE0007300_Cdc37_9
  gRNA
cauauguacggccauccccg

SEQ ID NO: 136522 - RNA, 20 nt, Artificial Sequence
  mmSKRIPTE0007301_Rhoa_1
  gRNA
aggcaguuacacucuaggug

SEQ ID NO: 136523 - RNA, 20 nt, Artificial Sequence
  mmSKRIPTE0007302_Rhoa_2
  gRNA
aggugaguacaagucccgcg

SEQ ID NO: 136524 - RNA, 20 nt, Artificial Sequence
  mmSKRIPTE0007303_Rhoa_3
  gRNA
aguggcaggcuaccccagcg

SEQ ID NO: 136525 - RNA, 20 nt, Artificial Sequence
  mmSKRIPTE0007304_Rhoa_4
  gRNA
cagccugaagcuuuaacccg

SEQ ID NO: 136526 - RNA, 20 nt, Artificial Sequence
  mmSKRIPTE0007305_Rhoa_5
  gRNA
aaacgaacuugguuacaguc

SEQ ID NO: 136527 - RNA, 20 nt, Artificial Sequence
  mmSKRIPTE0007306_Rhoa_6
  gRNA
gaaagguuguagcugugucg

SEQ ID NO: 136528 - RNA, 20 nt, Artificial Sequence
  mmSKRIPTE0007307_Rhoa_7
  gRNA
ugaucccagcacuguuccgg

SEQ ID NO: 136529 - RNA, 20 nt, Artificial Sequence
  mmSKRIPTE0007308_Rhoa_8
  gRNA
gaugcuaguaguaucccgcu

SEQ ID NO: 136530 - RNA, 20 nt, Artificial Sequence
  mmSKRIPTE0007309_Rhoa_9
  gRNA
uagcgguuaugacucuaugg

SEQ ID NO: 136531 - RNA, 20 nt, Artificial Sequence
  mmSKRIPTE0007310_Ccnd3_1
  gRNA
guggacgaauuacagcgcua

SEQ ID NO: 136532 - RNA, 20 nt, Artificial Sequence
  mmSKRIPTE0007311_Ccnd3_2
  gRNA
ugcacuuccgaguugcacac

SEQ ID NO: 136533 - RNA, 20 nt, Artificial Sequence
  mmSKRIPTE0007312_Ccnd3_3
  gRNA
ugguuccugugucuaucgcg

SEQ ID NO: 136534 - RNA, 20 nt, Artificial Sequence
  mmSKRIPTE0007313_Ccnd3_4
  gRNA
gggcguacaaucauaguugg

SEQ ID NO: 136535 - RNA, 20 nt, Artificial Sequence
  mmSKRIPTE0007314_Ccnd3_5
  gRNA
gaccggcaucauuaucacau

SEQ ID NO: 136536 - RNA, 20 nt, Artificial Sequence
  mmSKRIPTE0007315_Ccnd3_6
  gRNA
gagaccuggaugcgauguug

SEQ ID NO: 136537 - RNA, 20 nt, Artificial Sequence
  mmSKRIPTE0007316_Ccnd3_7
  gRNA
gccccaaacccgucaucccg

SEQ ID NO: 136538 - RNA, 20 nt, Artificial Sequence
  mmSKRIPTE0007317_Ccnd3_8
  gRNA
ccaagugaaacacggcagcg

SEQ ID NO: 136539 - RNA, 20 nt, Artificial Sequence
  mmSKRIPTE0007318_Ccnd3_9
  gRNA
ggagucagcagucggccgag

SEQ ID NO: 136540 - RNA, 20 nt, Artificial Sequence
  mmSKRIPTE0007319_Cfc1_1
  gRNA
gcacugaauaggcuuguaug

SEQ ID NO: 136541 - RNA, 20 nt, Artificial Sequence
  mmSKRIPTE0007320_Cfc1_2
  gRNA
gagagucuaucaucgcacuu

SEQ ID NO: 136542 - RNA, 20 nt, Artificial Sequence
  mmSKRIPTE0007321_Cfc1_3
  gRNA
gcuauugcgagcacgaccag

SEQ ID NO: 136543 - RNA, 20 nt, Artificial Sequence
  mmSKRIPTE0007322_Cfc1_4
  gRNA
uuccgaucguugugaaucgg

SEQ ID NO: 136544 - RNA, 20 nt, Artificial Sequence
  mmSKRIPTE0007323_Cfc1_5
  gRNA
cucaaauauccuagccccgg

SEQ ID NO: 136545 - RNA, 20 nt, Artificial Sequence
  mmSKRIPTE0007324_Cfc1_6
  gRNA
gcuuucuugcuggcacacug

SEQ ID NO: 136546 - RNA, 20 nt, Artificial Sequence
  mmSKRIPTE0007325_Cfc1_7
  gRNA
gcuauagugauuccaagacc

SEQ ID NO: 136547 - RNA, 20 nt, Artificial Sequence
  mmSKRIPTE0007326_Cfc1_8
  gRNA
auacagggacugcaccugca

SEQ ID NO: 136548 - RNA, 20 nt, Artificial Sequence
  mmSKRIPTE0007327_Cfc1_9
  gRNA
gaaagaaugacauuccggag

SEQ ID NO: 136549 - RNA, 20 nt, Artificial Sequence
  mmSKRIPTE0007328_Nr1d1_1
  gRNA
uucuggggccgaauauacgu

SEQ ID NO: 136550 - RNA, 20 nt, Artificial Sequence
  mmSKRIPTE0007329_Nr1d1_2
  gRNA
aauccugauugcgaacugcg

SEQ ID NO: 136551 - RNA, 20 nt, Artificial Sequence
  mmSKRIPTE0007330_Nr1d1_3
  gRNA
aaacucuaccaccucccgaa

SEQ ID NO: 136552 - RNA, 20 nt, Artificial Sequence
  mmSKRIPTE0007331_Nr1d1_4
  gRNA
agaguucgauucuguacaag

SEQ ID NO: 136553 - RNA, 20 nt, Artificial Sequence
  mmSKRIPTE0007332_Nr1d1_5
  gRNA
aaaagugcuugcuggcagcg

SEQ ID NO: 136554 - RNA, 20 nt, Artificial Sequence
  mmSKRIPTE0007333_Nr1d1_6
  gRNA
gcgcacagaucucaacgugc

SEQ ID NO: 136555 - RNA, 20 nt, Artificial Sequence
  mmSKRIPTE0007334_Nr1d1_7
  gRNA
gcgcugaauggucuacgcca

SEQ ID NO: 136556 - RNA, 20 nt, Artificial Sequence
  mmSKRIPTE0007335_Nr1d1_8
  gRNA
ccugccaacagucuacggca

SEQ ID NO: 136557 - RNA, 20 nt, Artificial Sequence
  mmSKRIPTE0007336_Nr1d1_9
  gRNA
acagacgacuauuucugccc

SEQ ID NO: 136558 - RNA, 20 nt, Artificial Sequence
  mmSKRIPTE0007337_Msh3_1
  gRNA
cugcacacugcaaugccccg

SEQ ID NO: 136559 - RNA, 20 nt, Artificial Sequence
  mmSKRIPTE0007338_Msh3_2
  gRNA
uuuguggcaguaucacgaug

SEQ ID NO: 136560 - RNA, 20 nt, Artificial Sequence
  mmSKRIPTE0007339_Msh3_3
  gRNA
uaaaacgauauucuggcacg

SEQ ID NO: 136561 - RNA, 20 nt, Artificial Sequence
  mmSKRIPTE0007340_Msh3_4
  gRNA
uacacaaauagaaugcgcgg

SEQ ID NO: 136562 - RNA, 20 nt, Artificial Sequence
  mmSKRIPTE0007341_Msh3_5
  gRNA
gaagguaaaguacggcuccg

SEQ ID NO: 136563 - RNA, 20 nt, Artificial Sequence
  mmSKRIPTE0007342_Msh3_6
  gRNA
ucgggaggcucuacugccgc

SEQ ID NO: 136564 - RNA, 20 nt, Artificial Sequence
  mmSKRIPTE0007343_Msh3_7
  gRNA
uucuaucguggugaauggcg

SEQ ID NO: 136565 - RNA, 20 nt, Artificial Sequence
  mmSKRIPTE0007344_Msh3_8
  gRNA
ucugcaacgugcaaagaaug

SEQ ID NO: 136566 - RNA, 20 nt, Artificial Sequence
  mmSKRIPTE0007345_Msh3_9
  gRNA
ucaaaucuauuaccgcuggu

SEQ ID NO: 136567 - RNA, 20 nt, Artificial Sequence
  mmSKRIPTE0007346_Nckap1l_1
  gRNA
cauugcguagcagaacguaa

SEQ ID NO: 136568 - RNA, 20 nt, Artificial Sequence
  mmSKRIPTE0007347_Nckap1l_2
  gRNA
guuuccuagacucagacucg

SEQ ID NO: 136569 - RNA, 20 nt, Artificial Sequence
  mmSKRIPTE0007348_Nckap1l_3
  gRNA
aauagugaugaaggucggag

SEQ ID NO: 136570 - RNA, 20 nt, Artificial Sequence
  mmSKRIPTE0007349_Nckap1l_4
  gRNA
guagccagccaaagucacga

SEQ ID NO: 136571 - RNA, 20 nt, Artificial Sequence
  mmSKRIPTE0007350_Nckap1l_5
  gRNA
gaagcagcagagcucuuacg

SEQ ID NO: 136572 - RNA, 20 nt, Artificial Sequence
  mmSKRIPTE0007351_Nckap1l_6
  gRNA
gcaggguuaaucauggccgg

SEQ ID NO: 136573 - RNA, 20 nt, Artificial Sequence
  mmSKRIPTE0007352_Nckap1l_7
  gRNA
cagaucagaugguagcccug

SEQ ID NO: 136574 - RNA, 20 nt, Artificial Sequence
  mmSKRIPTE0007353_Nckap1l_8
  gRNA
caggugaggguacuauggag

SEQ ID NO: 136575 - RNA, 20 nt, Artificial Sequence
  mmSKRIPTE0007354_Nckap1l_9
  gRNA
cucacgauccugaaugaccg

SEQ ID NO: 136576 - RNA, 20 nt, Artificial Sequence
  mmSKRIPTE0007355_Esrra_1
  gRNA
auaggguguuagccccaaag

SEQ ID NO: 136577 - RNA, 20 nt, Artificial Sequence
  mmSKRIPTE0007356_Esrra_2
  gRNA
agcccccuauggcuuccgcg

SEQ ID NO: 136578 - RNA, 20 nt, Artificial Sequence
  mmSKRIPTE0007357_Esrra_3
  gRNA
uggcuucuaggcuaaaucca

SEQ ID NO: 136579 - RNA, 20 nt, Artificial Sequence
  mmSKRIPTE0007358_Esrra_4
  gRNA
gacggcagaaguacaaacgg

SEQ ID NO: 136580 - RNA, 20 nt, Artificial Sequence
  mmSKRIPTE0007359_Esrra_5
  gRNA
guugcccaaccuauguggca

SEQ ID NO: 136581 - RNA, 20 nt, Artificial Sequence
  mmSKRIPTE0007360_Esrra_6
  gRNA
ggugugcgcagguuaauggg

SEQ ID NO: 136582 - RNA, 20 nt, Artificial Sequence
  mmSKRIPTE0007361_Esrra_7
  gRNA
cgauggacaccuccccgcug

SEQ ID NO: 136583 - RNA, 20 nt, Artificial Sequence
  mmSKRIPTE0007362_Esrra_8
  gRNA
gagacucccuuacaagagug

SEQ ID NO: 136584 - RNA, 20 nt, Artificial Sequence
  mmSKRIPTE0007363_Esrra_9
  gRNA
gccugcgcaugcaaaacagg

SEQ ID NO: 136585 - RNA, 20 nt, Artificial Sequence
  mmSKRIPTE0007364_Edn3_1
  gRNA
aggcgcgggucuguguugcg

SEQ ID NO: 136586 - RNA, 20 nt, Artificial Sequence
  mmSKRIPTE0007365_Edn3_2
  gRNA
ccggguucaaaggcccagcg

SEQ ID NO: 136587 - RNA, 20 nt, Artificial Sequence
  mmSKRIPTE0007366_Edn3_3
  gRNA
gacaggauacauucauuccg

SEQ ID NO: 136588 - RNA, 20 nt, Artificial Sequence
  mmSKRIPTE0007367_Edn3_4
  gRNA
acaaguugggaauuggccug

SEQ ID NO: 136589 - RNA, 20 nt, Artificial Sequence
  mmSKRIPTE0007368_Edn3_5
  gRNA
uagauccagcuaaggccggu

SEQ ID NO: 136590 - RNA, 20 nt, Artificial Sequence
  mmSKRIPTE0007369_Edn3_6
  gRNA
caucuuagcaugggacggca

SEQ ID NO: 136591 - RNA, 20 nt, Artificial Sequence
  mmSKRIPTE0007370_Edn3_7
  gRNA
uccugagugaguuggccuag

SEQ ID NO: 136592 - RNA, 20 nt, Artificial Sequence
  mmSKRIPTE0007371_Edn3_8
  gRNA
gcuugcguuguacuuguaug

SEQ ID NO: 136593 - RNA, 20 nt, Artificial Sequence
  mmSKRIPTE0007372_Edn3_9
  gRNA
gccuucacaaaaguggcuag

SEQ ID NO: 136594 - RNA, 20 nt, Artificial Sequence
  mmSKRIPTE0007373_Fgb_1
  gRNA
gcacggcacagaugauggug

SEQ ID NO: 136595 - RNA, 20 nt, Artificial Sequence
  mmSKRIPTE0007374_Fgb_2
  gRNA
acgacggcugguaagcacca

SEQ ID NO: 136596 - RNA, 20 nt, Artificial Sequence
  mmSKRIPTE0007375_Fgb_3
  gRNA
gucauacagaaccgucagga

SEQ ID NO: 136597 - RNA, 20 nt, Artificial Sequence
  mmSKRIPTE0007376_Fgb_4
  gRNA
ucgggcaagaucgcagugca

SEQ ID NO: 136598 - RNA, 20 nt, Artificial Sequence
  mmSKRIPTE0007377_Fgb_5
  gRNA
gaagacagccuccugcaucg

SEQ ID NO: 136599 - RNA, 20 nt, Artificial Sequence
  mmSKRIPTE0007378_Fgb_6
  gRNA
acaccuucaugcaugcaucg

SEQ ID NO: 136600 - RNA, 20 nt, Artificial Sequence
  mmSKRIPTE0007379_Fgb_7
  gRNA
aaugcgauugucuagcacug

SEQ ID NO: 136601 - RNA, 20 nt, Artificial Sequence
  mmSKRIPTE0007380_Fgb_8
  gRNA
uacguaaggaguucgggaug

SEQ ID NO: 136602 - RNA, 20 nt, Artificial Sequence
  mmSKRIPTE0007381_Fgb_9
  gRNA
ccauuccugaagucaugccg

SEQ ID NO: 136603 - RNA, 20 nt, Artificial Sequence
  mmSKRIPTE0007382_Ntrk1_1
  gRNA
acuaaugagaccaugcggca

SEQ ID NO: 136604 - RNA, 20 nt, Artificial Sequence
  mmSKRIPTE0007383_Ntrk1_2
  gRNA
gcggaggccacucuucacga

SEQ ID NO: 136605 - RNA, 20 nt, Artificial Sequence
  mmSKRIPTE0007384_Ntrk1_3
  gRNA
cugccacccaggguacggag

SEQ ID NO: 136606 - RNA, 20 nt, Artificial Sequence
  mmSKRIPTE0007385_Ntrk1_4
  gRNA
acacucgaucgccugcgcca

SEQ ID NO: 136607 - RNA, 20 nt, Artificial Sequence
  mmSKRIPTE0007386_Ntrk1_5
  gRNA
auuugggaucaaccgugagu

SEQ ID NO: 136608 - RNA, 20 nt, Artificial Sequence
  mmSKRIPTE0007387_Ntrk1_6
  gRNA
cugggucagaguaaggucgc

SEQ ID NO: 136609 - RNA, 20 nt, Artificial Sequence
  mmSKRIPTE0007388_Ntrk1_7
  gRNA
caucagacugccuagccccg

SEQ ID NO: 136610 - RNA, 20 nt, Artificial Sequence
  mmSKRIPTE0007389_Ntrk1_8
  gRNA
cugugagugugugucguucg

SEQ ID NO: 136611 - RNA, 20 nt, Artificial Sequence
  mmSKRIPTE0007390_Ntrk1_9
  gRNA
gcgagaaggagacugcggca

SEQ ID NO: 136612 - RNA, 20 nt, Artificial Sequence
  mmSKRIPTE0007391_Hmgb1_1
  gRNA
caaacacuaggcacucgacg

SEQ ID NO: 136613 - RNA, 20 nt, Artificial Sequence
  mmSKRIPTE0007392_Hmgb1_2
  gRNA
cguagugauauacugugcaa

SEQ ID NO: 136614 - RNA, 20 nt, Artificial Sequence
  mmSKRIPTE0007393_Hmgb1_3
  gRNA
ucauaagcucauacucacgg

SEQ ID NO: 136615 - RNA, 20 nt, Artificial Sequence
  mmSKRIPTE0007394_Hmgb1_4
  gRNA
ccauagccaauuccuagaag

SEQ ID NO: 136616 - RNA, 20 nt, Artificial Sequence
  mmSKRIPTE0007395_Hmgb1_5
  gRNA
guaaacuuuaggugcacgag

SEQ ID NO: 136617 - RNA, 20 nt, Artificial Sequence
  mmSKRIPTE0007396_Hmgb1_6
  gRNA
uaguauguauccaaauuugg

SEQ ID NO: 136618 - RNA, 20 nt, Artificial Sequence
  mmSKRIPTE0007397_Hmgb1_7
  gRNA
gcuugggucguguauuugag

SEQ ID NO: 136619 - RNA, 20 nt, Artificial Sequence
  mmSKRIPTE0007398_Hmgb1_8
  gRNA
cagagcagaaacgcaucucg

SEQ ID NO: 136620 - RNA, 20 nt, Artificial Sequence
  mmSKRIPTE0007399_Hmgb1_9
  gRNA
uacucggagaaacuucagac

SEQ ID NO: 136621 - RNA, 20 nt, Artificial Sequence
  mmSKRIPTE0007400_Snca_1
  gRNA
ucacaggcaccuauaaugcg

SEQ ID NO: 136622 - RNA, 20 nt, Artificial Sequence
  mmSKRIPTE0007401_Snca_2
  gRNA
ucaaaugaguaccuuaacca

SEQ ID NO: 136623 - RNA, 20 nt, Artificial Sequence
  mmSKRIPTE0007402_Snca_3
  gRNA
gagggcccucugaacucgag

SEQ ID NO: 136624 - RNA, 20 nt, Artificial Sequence
  mmSKRIPTE0007403_Snca_4
  gRNA
cccuaaggcagucgacccug

SEQ ID NO: 136625 - RNA, 20 nt, Artificial Sequence
  mmSKRIPTE0007404_Snca_5
  gRNA
ccucuaaaagugcagagcga

SEQ ID NO: 136626 - RNA, 20 nt, Artificial Sequence
  mmSKRIPTE0007405_Snca_6
  gRNA
acaugucuuaaggaaccgag

SEQ ID NO: 136627 - RNA, 20 nt, Artificial Sequence
  mmSKRIPTE0007406_Snca_7
  gRNA
acacugugacuaaugaauug

SEQ ID NO: 136628 - RNA, 20 nt, Artificial Sequence
  mmSKRIPTE0007407_Snca_8
  gRNA
agagagaucugauaguggca

SEQ ID NO: 136629 - RNA, 20 nt, Artificial Sequence
  mmSKRIPTE0007408_Snca_9
  gRNA
ugugaaacgucaucuuccag

SEQ ID NO: 136630 - RNA, 20 nt, Artificial Sequence
  mmSKRIPTE0007409_Mitf_1
  gRNA
guugguaacgcuccccagug

SEQ ID NO: 136631 - RNA, 20 nt, Artificial Sequence
  mmSKRIPTE0007410_Mitf_2
  gRNA
aguuucgugaaauuaagcag

SEQ ID NO: 136632 - RNA, 20 nt, Artificial Sequence
  mmSKRIPTE0007411_Mitf_3
  gRNA
caccaguagaucuaggacag

SEQ ID NO: 136633 - RNA, 20 nt, Artificial Sequence
  mmSKRIPTE0007412_Mitf_4
  gRNA
aguccauugcuaagggcgag

SEQ ID NO: 136634 - RNA, 20 nt, Artificial Sequence
  mmSKRIPTE0007413_Mitf_5
  gRNA
gaguaccuagcuccuuaaug

SEQ ID NO: 136635 - RNA, 20 nt, Artificial Sequence
  mmSKRIPTE0007414_Mitf_6
  gRNA
uuuaucacagagacaugcgg

SEQ ID NO: 136636 - RNA, 20 nt, Artificial Sequence
  mmSKRIPTE0007415_Mitf_7
  gRNA
gagagugcguguucauaccu

SEQ ID NO: 136637 - RNA, 20 nt, Artificial Sequence
  mmSKRIPTE0007416_Mitf_8
  gRNA
ggaccaagaacguccuuuag

SEQ ID NO: 136638 - RNA, 20 nt, Artificial Sequence
  mmSKRIPTE0007417_Mitf_9
  gRNA
uggguguugacugacugcag

SEQ ID NO: 136639 - RNA, 20 nt, Artificial Sequence
  mmSKRIPTE0007418_Tarm1_1
  gRNA
caguugcggugggaaagucg

SEQ ID NO: 136640 - RNA, 20 nt, Artificial Sequence
  mmSKRIPTE0007419_Tarm1_2
  gRNA
acgcaaacuuuacggguccg

SEQ ID NO: 136641 - RNA, 20 nt, Artificial Sequence
  mmSKRIPTE0007420_Tarm1_3
  gRNA
cugcagucacuguaccccgg

SEQ ID NO: 136642 - RNA, 20 nt, Artificial Sequence
  mmSKRIPTE0007421_Tarm1_4
  gRNA
ucaacagcaagguuaccugu

SEQ ID NO: 136643 - RNA, 20 nt, Artificial Sequence
  mmSKRIPTE0007422_Tarm1_5
  gRNA
gccaucauucugucguaggu

SEQ ID NO: 136644 - RNA, 20 nt, Artificial Sequence
  mmSKRIPTE0007423_Tarm1_6
  gRNA
ucugugugaucaauacugag

SEQ ID NO: 136645 - RNA, 20 nt, Artificial Sequence
  mmSKRIPTE0007424_Tarm1_7
  gRNA
gugaccaucacuugccgcag

SEQ ID NO: 136646 - RNA, 20 nt, Artificial Sequence
  mmSKRIPTE0007425_Tarm1_8
  gRNA
ccuccguaaguuauucaggg

SEQ ID NO: 136647 - RNA, 20 nt, Artificial Sequence
  mmSKRIPTE0007426_Tarm1_9
  gRNA
auuugcgauuggguaucaug

SEQ ID NO: 136648 - RNA, 20 nt, Artificial Sequence
  mmSKRIPTE0007427_Cmtm3_1
  gRNA
cccgauccagaguccgcgca

SEQ ID NO: 136649 - RNA, 20 nt, Artificial Sequence
  mmSKRIPTE0007428_Cmtm3_2
  gRNA
gcagcguccacggaacacgg

SEQ ID NO: 136650 - RNA, 20 nt, Artificial Sequence
  mmSKRIPTE0007429_Cmtm3_3
  gRNA
uaccgggcuucacgcacccg

SEQ ID NO: 136651 - RNA, 20 nt, Artificial Sequence
  mmSKRIPTE0007430_Cmtm3_4
  gRNA
aggugaguggccaaucugug

SEQ ID NO: 136652 - RNA, 20 nt, Artificial Sequence
  mmSKRIPTE0007431_Cmtm3_5
  gRNA
gaccagauagcgccgcuaug

SEQ ID NO: 136653 - RNA, 20 nt, Artificial Sequence
  mmSKRIPTE0007432_Cmtm3_6
  gRNA
cucucaagauuacacucccg

SEQ ID NO: 136654 - RNA, 20 nt, Artificial Sequence
  mmSKRIPTE0007433_Cmtm3_7
  gRNA
aauccgggaagaacacggcu

SEQ ID NO: 136655 - RNA, 20 nt, Artificial Sequence
  mmSKRIPTE0007434_Cmtm3_8
  gRNA
cugcguagagaauggucgga

SEQ ID NO: 136656 - RNA, 20 nt, Artificial Sequence
  mmSKRIPTE0007435_Cmtm3_9
  gRNA
ccauggacggaccugauggg

SEQ ID NO: 136657 - RNA, 20 nt, Artificial Sequence
  mmSKRIPTE0007436_Ecsit_1
  gRNA
gcgcgacccaccuacucacg

SEQ ID NO: 136658 - RNA, 20 nt, Artificial Sequence
  mmSKRIPTE0007437_Ecsit_2
  gRNA
cccaacaccgaccaacggag

SEQ ID NO: 136659 - RNA, 20 nt, Artificial Sequence
  mmSKRIPTE0007438_Ecsit_3
  gRNA
agcucauuuagugggcccag

SEQ ID NO: 136660 - RNA, 20 nt, Artificial Sequence
  mmSKRIPTE0007439_Ecsit_4
  gRNA
gugcucagaguacgucacag

SEQ ID NO: 136661 - RNA, 20 nt, Artificial Sequence
  mmSKRIPTE0007440_Ecsit_5
  gRNA
acucguaaccggaagcuccg

SEQ ID NO: 136662 - RNA, 20 nt, Artificial Sequence
  mmSKRIPTE0007441_Ecsit_6
  gRNA
agcccaugcagaacauacga

SEQ ID NO: 136663 - RNA, 20 nt, Artificial Sequence
  mmSKRIPTE0007442_Ecsit_7
  gRNA
ccguuucacagaugggaccg

SEQ ID NO: 136664 - RNA, 20 nt, Artificial Sequence
  mmSKRIPTE0007443_Ecsit_8
  gRNA
cuggagcagauggaacgaca

SEQ ID NO: 136665 - RNA, 20 nt, Artificial Sequence
  mmSKRIPTE0007444_Ecsit_9
  gRNA
ugcgucacagacaagaugug

SEQ ID NO: 136666 - RNA, 20 nt, Artificial Sequence
  mmSKRIPTE0007445_Srms_1
  gRNA
cgauguacacagguucaccg

SEQ ID NO: 136667 - RNA, 20 nt, Artificial Sequence
  mmSKRIPTE0007446_Srms_2
  gRNA
guacuucagugggaucagca

SEQ ID NO: 136668 - RNA, 20 nt, Artificial Sequence
  mmSKRIPTE0007447_Srms_3
  gRNA
guagauaaaaccgccgaagg

SEQ ID NO: 136669 - RNA, 20 nt, Artificial Sequence
  mmSKRIPTE0007448_Srms_4
  gRNA
ucauccccacuaacagacgc

SEQ ID NO: 136670 - RNA, 20 nt, Artificial Sequence
  mmSKRIPTE0007449_Srms_5
  gRNA
cagaccaaccguaaguaccu

SEQ ID NO: 136671 - RNA, 20 nt, Artificial Sequence
  mmSKRIPTE0007450_Srms_6
  gRNA
gggacuacaucuuugcccaa

SEQ ID NO: 136672 - RNA, 20 nt, Artificial Sequence
  mmSKRIPTE0007451_Srms_7
  gRNA
acaauagucuaugcaagagg

SEQ ID NO: 136673 - RNA, 20 nt, Artificial Sequence
  mmSKRIPTE0007452_Srms_8
  gRNA
gaagguuaucaaaucaggug

SEQ ID NO: 136674 - RNA, 20 nt, Artificial Sequence
  mmSKRIPTE0007453_Srms_9
  gRNA
gacacgaaucucaagcccag

SEQ ID NO: 136675 - RNA, 20 nt, Artificial Sequence
  mmSKRIPTE0007454_Ccl12_1
  gRNA
acuuacaucacagcuucccg

SEQ ID NO: 136676 - RNA, 20 nt, Artificial Sequence
  mmSKRIPTE0007455_Ccl12_2
  gRNA
ccugguccagccaauaccug

SEQ ID NO: 136677 - RNA, 20 nt, Artificial Sequence
  mmSKRIPTE0007456_Ccl12_3
  gRNA
gucagguccccuacucaccu

SEQ ID NO: 136678 - RNA, 20 nt, Artificial Sequence
  mmSKRIPTE0007457_Ccl12_4
  gRNA
uaaauaucacacugcccgug

SEQ ID NO: 136679 - RNA, 20 nt, Artificial Sequence
  mmSKRIPTE0007458_Ccl12_5
  gRNA
uggugucacgaaacaucaca

SEQ ID NO: 136680 - RNA, 20 nt, Artificial Sequence
  mmSKRIPTE0007459_Ccl12_6
  gRNA
gcuuacucagcauaguccug

SEQ ID NO: 136681 - RNA, 20 nt, Artificial Sequence
  mmSKRIPTE0007460_Ccl12_7
  gRNA
cugagaggaaaucaccccug

SEQ ID NO: 136682 - RNA, 20 nt, Artificial Sequence
  mmSKRIPTE0007461_Ccl12_8
  gRNA
uuagacagcgaaacagaugg

SEQ ID NO: 136683 - RNA, 20 nt, Artificial Sequence
  mmSKRIPTE0007462_Ccl12_9
  gRNA
uuugagacgucuuauccaag

SEQ ID NO: 136684 - RNA, 20 nt, Artificial Sequence
  mmSKRIPTE0007463_Hexim1_1
  gRNA
ccgaugacgcugccucggag

SEQ ID NO: 136685 - RNA, 20 nt, Artificial Sequence
  mmSKRIPTE0007464_Hexim1_2
  gRNA
gccgagugcucccacagacg

SEQ ID NO: 136686 - RNA, 20 nt, Artificial Sequence
  mmSKRIPTE0007465_Hexim1_3
  gRNA
ucuauauauaagaggcgccg

SEQ ID NO: 136687 - RNA, 20 nt, Artificial Sequence
  mmSKRIPTE0007466_Hexim1_4
  gRNA
ggguuaagcgcacacaagcg

SEQ ID NO: 136688 - RNA, 20 nt, Artificial Sequence
  mmSKRIPTE0007467_Hexim1_5
  gRNA
acuucucggagacguacgag

SEQ ID NO: 136689 - RNA, 20 nt, Artificial Sequence
  mmSKRIPTE0007468_Hexim1_6
  gRNA
uggacggcuaccggacugca

SEQ ID NO: 136690 - RNA, 20 nt, Artificial Sequence
  mmSKRIPTE0007469_Hexim1_7
  gRNA
cgagccgagauguucgccaa

SEQ ID NO: 136691 - RNA, 20 nt, Artificial Sequence
  mmSKRIPTE0007470_Hexim1_8
  gRNA
agcggagcaucgagccagag

SEQ ID NO: 136692 - RNA, 20 nt, Artificial Sequence
  mmSKRIPTE0007471_Hexim1_9
  gRNA
gaguuugcugacaggacgga

SEQ ID NO: 136693 - RNA, 20 nt, Artificial Sequence
  mmSKRIPTE0007472_Tigit_1
  gRNA
acucauuagaggaucuuucg

SEQ ID NO: 136694 - RNA, 20 nt, Artificial Sequence
  mmSKRIPTE0007473_Tigit_2
  gRNA
ccuaucauacguauccuggu

SEQ ID NO: 136695 - RNA, 20 nt, Artificial Sequence
  mmSKRIPTE0007474_Tigit_3
  gRNA
ugcaagccuuaccuguagcg

SEQ ID NO: 136696 - RNA, 20 nt, Artificial Sequence
  mmSKRIPTE0007475_Tigit_4
  gRNA
gugaugaacguagaaccuug

SEQ ID NO: 136697 - RNA, 20 nt, Artificial Sequence
  mmSKRIPTE0007476_Tigit_5
  gRNA
aaucaaugauggucucuaug

SEQ ID NO: 136698 - RNA, 20 nt, Artificial Sequence
  mmSKRIPTE0007477_Tigit_6
  gRNA
uucagucuucagugaucggg

SEQ ID NO: 136699 - RNA, 20 nt, Artificial Sequence
  mmSKRIPTE0007478_Tigit_7
  gRNA
agccaugguuccuccaagcg

SEQ ID NO: 136700 - RNA, 20 nt, Artificial Sequence
  mmSKRIPTE0007479_Tigit_8
  gRNA
gcuguaaggugaaaccaagc

SEQ ID NO: 136701 - RNA, 20 nt, Artificial Sequence
  mmSKRIPTE0007480_Tigit_9
  gRNA
agcgauugccucuuaccaug

SEQ ID NO: 136702 - RNA, 20 nt, Artificial Sequence
  mmSKRIPTE0007481_Fpr1_1
  gRNA
agaagguaaucaucguaccc

SEQ ID NO: 136703 - RNA, 20 nt, Artificial Sequence
  mmSKRIPTE0007482_Fpr1_2
  gRNA
guaccacauuaacugcacag

SEQ ID NO: 136704 - RNA, 20 nt, Artificial Sequence
  mmSKRIPTE0007483_Fpr1_3
  gRNA
ccacaauccaaguccgugaa

SEQ ID NO: 136705 - RNA, 20 nt, Artificial Sequence
  mmSKRIPTE0007484_Fpr1_4
  gRNA
auugccagcauggucauggg

SEQ ID NO: 136706 - RNA, 20 nt, Artificial Sequence
  mmSKRIPTE0007485_Fpr1_5
  gRNA
cggccugugagugaacuaag

SEQ ID NO: 136707 - RNA, 20 nt, Artificial Sequence
  mmSKRIPTE0007486_Fpr1_6
  gRNA
guuuccagaacaauccaacc

SEQ ID NO: 136708 - RNA, 20 nt, Artificial Sequence
  mmSKRIPTE0007487_Fpr1_7
  gRNA
ccuaauaguagacuuggacc

SEQ ID NO: 136709 - RNA, 20 nt, Artificial Sequence
  mmSKRIPTE0007488_Fpr1_8
  gRNA
caacgggcucgugaucuggg

SEQ ID NO: 136710 - RNA, 20 nt, Artificial Sequence
  mmSKRIPTE0007489_Fpr1_9
  gRNA
acaaaggagagaacccgcaa

SEQ ID NO: 136711 - RNA, 20 nt, Artificial Sequence
  mmSKRIPTE0007490_Lbp_1
  gRNA
uggcggugucaaccccggug

SEQ ID NO: 136712 - RNA, 20 nt, Artificial Sequence
  mmSKRIPTE0007491_Lbp_2
  gRNA
ccugcaucacgggcuauucg

SEQ ID NO: 136713 - RNA, 20 nt, Artificial Sequence
  mmSKRIPTE0007492_Lbp_3
  gRNA
gucacucccaagagguacgg

SEQ ID NO: 136714 - RNA, 20 nt, Artificial Sequence
  mmSKRIPTE0007493_Lbp_4
  gRNA
uaaacuuagugagaccacgu

SEQ ID NO: 136715 - RNA, 20 nt, Artificial Sequence
  mmSKRIPTE0007494_Lbp_5
  gRNA
gagucugcuauacggguaug

SEQ ID NO: 136716 - RNA, 20 nt, Artificial Sequence
  mmSKRIPTE0007495_Lbp_6
  gRNA
uggcuagagaagcuuucugc

SEQ ID NO: 136717 - RNA, 20 nt, Artificial Sequence
  mmSKRIPTE0007496_Lbp_7
  gRNA
cuggggguuguuauaccaug

SEQ ID NO: 136718 - RNA, 20 nt, Artificial Sequence
  mmSKRIPTE0007497_Lbp_8
  gRNA
acccucuugcgacaccacag

SEQ ID NO: 136719 - RNA, 20 nt, Artificial Sequence
  mmSKRIPTE0007498_Lbp_9
  gRNA
uagauuccacaucuucuaag

SEQ ID NO: 136720 - RNA, 20 nt, Artificial Sequence
  mmSKRIPTE0007499_Mknk2_1
  gRNA
acauaugccccugccccgcg

SEQ ID NO: 136721 - RNA, 20 nt, Artificial Sequence
  mmSKRIPTE0007500_Mknk2_2
  gRNA
agucguaagauagcacguga

SEQ ID NO: 136722 - RNA, 20 nt, Artificial Sequence
  mmSKRIPTE0007501_Mknk2_3
  gRNA
gucucauaggaucgucacag

SEQ ID NO: 136723 - RNA, 20 nt, Artificial Sequence
  mmSKRIPTE0007502_Mknk2_4
  gRNA
uggguaccucuaaagcaacc

SEQ ID NO: 136724 - RNA, 20 nt, Artificial Sequence
  mmSKRIPTE0007503_Mknk2_5
  gRNA
cugguguuugagaagaugcg

SEQ ID NO: 136725 - RNA, 20 nt, Artificial Sequence
  mmSKRIPTE0007504_Mknk2_6
  gRNA
ccugugggcgaugccuagug

SEQ ID NO: 136726 - RNA, 20 nt, Artificial Sequence
  mmSKRIPTE0007505_Mknk2_7
  gRNA
caucuggaaugcgaguggag

SEQ ID NO: 136727 - RNA, 20 nt, Artificial Sequence
  mmSKRIPTE0007506_Mknk2_8
  gRNA
cgccuuuacugcccucaccg

SEQ ID NO: 136728 - RNA, 20 nt, Artificial Sequence
  mmSKRIPTE0007507_Mknk2_9
  gRNA
gcugggaguaguucccaaug

SEQ ID NO: 136729 - RNA, 20 nt, Artificial Sequence
  mmSKRIPTE0007508_Nlrp3_1
  gRNA
guucuuuauccacugccgag

SEQ ID NO: 136730 - RNA, 20 nt, Artificial Sequence
  mmSKRIPTE0007509_Nlrp3_2
  gRNA
cccccauagugugagcgugu

SEQ ID NO: 136731 - RNA, 20 nt, Artificial Sequence
  mmSKRIPTE0007510_Nlrp3_3
  gRNA
cgauaacgugaaacugccag

SEQ ID NO: 136732 - RNA, 20 nt, Artificial Sequence
  mmSKRIPTE0007511_Nlrp3_4
  gRNA
cguagcaucagcauccgaag

SEQ ID NO: 136733 - RNA, 20 nt, Artificial Sequence
  mmSKRIPTE0007512_Nlrp3_5
  gRNA
gaccagaacccauggugacg

SEQ ID NO: 136734 - RNA, 20 nt, Artificial Sequence
  mmSKRIPTE0007513_Nlrp3_6
  gRNA
ugaucuuggcgaucugugcg

SEQ ID NO: 136735 - RNA, 20 nt, Artificial Sequence
  mmSKRIPTE0007514_Nlrp3_7
  gRNA
guguugucaggaucucgcau

SEQ ID NO: 136736 - RNA, 20 nt, Artificial Sequence
  mmSKRIPTE0007515_Nlrp3_8
  gRNA
caugauugacuucaauggcg

SEQ ID NO: 136737 - RNA, 20 nt, Artificial Sequence
  mmSKRIPTE0007516_Nlrp3_9
  gRNA
caccaucaggaucacagccg

SEQ ID NO: 136738 - RNA, 20 nt, Artificial Sequence
  mmSKRIPTE0007517_Hoxb6_1
  gRNA
ugugcgcagucggacuugcg

SEQ ID NO: 136739 - RNA, 20 nt, Artificial Sequence
  mmSKRIPTE0007518_Hoxb6_2
  gRNA
cgaaauaggaacucaucggg

SEQ ID NO: 136740 - RNA, 20 nt, Artificial Sequence
  mmSKRIPTE0007519_Hoxb6_3
  gRNA
gcuccggacgugaaauacuu

SEQ ID NO: 136741 - RNA, 20 nt, Artificial Sequence
  mmSKRIPTE0007520_Hoxb6_4
  gRNA
ggggaaagacuacucccgac

SEQ ID NO: 136742 - RNA, 20 nt, Artificial Sequence
  mmSKRIPTE0007521_Hoxb6_5
  gRNA
cuuuacguuugagggccgag

SEQ ID NO: 136743 - RNA, 20 nt, Artificial Sequence
  mmSKRIPTE0007522_Hoxb6_6
  gRNA
ggcuauacuacuaauaggcg

SEQ ID NO: 136744 - RNA, 20 nt, Artificial Sequence
  mmSKRIPTE0007523_Hoxb6_7
  gRNA
ggcgccggcccauaaucaca

SEQ ID NO: 136745 - RNA, 20 nt, Artificial Sequence
  mmSKRIPTE0007524_Hoxb6_8
  gRNA
uaccauugaaccgugcacgg

SEQ ID NO: 136746 - RNA, 20 nt, Artificial Sequence
  mmSKRIPTE0007525_Hoxb6_9
  gRNA
aggccaagguggguucuucg

SEQ ID NO: 136747 - RNA, 20 nt, Artificial Sequence
  mmSKRIPTE0007526_Hif1a_1
  gRNA
agcuagccggaggagcgccu

SEQ ID NO: 136748 - RNA, 20 nt, Artificial Sequence
  mmSKRIPTE0007527_Hif1a_2
  gRNA
cacagacaagcacgugagcg

SEQ ID NO: 136749 - RNA, 20 nt, Artificial Sequence
  mmSKRIPTE0007528_Hif1a_3
  gRNA
agauggcgacguggaccgcg

SEQ ID NO: 136750 - RNA, 20 nt, Artificial Sequence
  mmSKRIPTE0007529_Hif1a_4
  gRNA
cauacuguuacuauuaacgc

SEQ ID NO: 136751 - RNA, 20 nt, Artificial Sequence
  mmSKRIPTE0007530_Hif1a_5
  gRNA
agccaguccacggaacgcgg

SEQ ID NO: 136752 - RNA, 20 nt, Artificial Sequence
  mmSKRIPTE0007531_Hif1a_6
  gRNA
aguaagaaaauuucauaucg

SEQ ID NO: 136753 - RNA, 20 nt, Artificial Sequence
  mmSKRIPTE0007532_Hif1a_7
  gRNA
caucaagucagcaacgugga

SEQ ID NO: 136754 - RNA, 20 nt, Artificial Sequence
  mmSKRIPTE0007533_Hif1a_8
  gRNA
aucagcaccaagcacgucau

SEQ ID NO: 136755 - RNA, 20 nt, Artificial Sequence
  mmSKRIPTE0007534_Hif1a_9
  gRNA
gaugcucaagaagaacaugu

SEQ ID NO: 136756 - RNA, 20 nt, Artificial Sequence
  mmSKRIPTE0007535_Igha_1
  gRNA
caacacgcuugucaccaggu

SEQ ID NO: 136757 - RNA, 20 nt, Artificial Sequence
  mmSKRIPTE0007536_Igha_2
  gRNA
ucggucuuagcucugaaacg

SEQ ID NO: 136758 - RNA, 20 nt, Artificial Sequence
  mmSKRIPTE0007537_Igha_3
  gRNA
cucugguaaagaacguuagg

SEQ ID NO: 136759 - RNA, 20 nt, Artificial Sequence
  mmSKRIPTE0007538_Igha_4
  gRNA
ugguggguuuacccgacaga

SEQ ID NO: 136760 - RNA, 20 nt, Artificial Sequence
  mmSKRIPTE0007539_Igha_5
  gRNA
agucaucggugaucaagacu

SEQ ID NO: 136761 - RNA, 20 nt, Artificial Sequence
  mmSKRIPTE0007540_Igha_6
  gRNA
ucaggcagccgauuaucacu

SEQ ID NO: 136762 - RNA, 20 nt, Artificial Sequence
  mmSKRIPTE0007541_Igha_7
  gRNA
aggaucaggccuuagugacg

SEQ ID NO: 136763 - RNA, 20 nt, Artificial Sequence
  mmSKRIPTE0007542_Igha_8
  gRNA
ucacauucaucgugccggaa

SEQ ID NO: 136764 - RNA, 20 nt, Artificial Sequence
  mmSKRIPTE0007543_Igha_9
  gRNA
gagcucgugggagugucagu

SEQ ID NO: 136765 - RNA, 20 nt, Artificial Sequence
  mmSKRIPTE0007544_Thpo_1
  gRNA
gauagacaaagggucgacgu

SEQ ID NO: 136766 - RNA, 20 nt, Artificial Sequence
  mmSKRIPTE0007545_Thpo_2
  gRNA
ggcuugugacccuacuacag

SEQ ID NO: 136767 - RNA, 20 nt, Artificial Sequence
  mmSKRIPTE0007546_Thpo_3
  gRNA
guuguugcaagcucaagaag

SEQ ID NO: 136768 - RNA, 20 nt, Artificial Sequence
  mmSKRIPTE0007547_Thpo_4
  gRNA
gccaagcauagcccuuguca

SEQ ID NO: 136769 - RNA, 20 nt, Artificial Sequence
  mmSKRIPTE0007548_Thpo_5
  gRNA
auaugguguagcaucuaccu

SEQ ID NO: 136770 - RNA, 20 nt, Artificial Sequence
  mmSKRIPTE0007549_Thpo_6
  gRNA
acucuggggaacaaguaggu

SEQ ID NO: 136771 - RNA, 20 nt, Artificial Sequence
  mmSKRIPTE0007550_Thpo_7
  gRNA
ugaguggcaagcaccauuug

SEQ ID NO: 136772 - RNA, 20 nt, Artificial Sequence
  mmSKRIPTE0007551_Thpo_8
  gRNA
ucagaagaggccugauaugu

SEQ ID NO: 136773 - RNA, 20 nt, Artificial Sequence
  mmSKRIPTE0007552_Thpo_9
  gRNA
agcuccgggcgagaugucug

SEQ ID NO: 136774 - RNA, 20 nt, Artificial Sequence
  mmSKRIPTE0007553_H2-Q2_1
  gRNA
aagggaaaccgauuccaggu

SEQ ID NO: 136775 - RNA, 20 nt, Artificial Sequence
  mmSKRIPTE0007554_H2-Q2_2
  gRNA
ccagacggaagccuacuccg

SEQ ID NO: 136776 - RNA, 20 nt, Artificial Sequence
  mmSKRIPTE0007555_H2-Q2_3
  gRNA
uggaggucgauugcuugacg

SEQ ID NO: 136777 - RNA, 20 nt, Artificial Sequence
  mmSKRIPTE0007556_H2-Q2_4
  gRNA
agcugaccacgggaucccgu

SEQ ID NO: 136778 - RNA, 20 nt, Artificial Sequence
  mmSKRIPTE0007557_H2-Q2_5
  gRNA
aagguauggugggcgacgug

SEQ ID NO: 136779 - RNA, 20 nt, Artificial Sequence
  mmSKRIPTE0007558_H2-Q2_6
  gRNA
gaaacugacugagacacgcg

SEQ ID NO: 136780 - RNA, 20 nt, Artificial Sequence
  mmSKRIPTE0007559_H2-Q2_7
  gRNA
gaaacagcgucugcggagag

SEQ ID NO: 136781 - RNA, 20 nt, Artificial Sequence
  mmSKRIPTE0007560_H2-Q2_8
  gRNA
cagacggaagccuacuccga

SEQ ID NO: 136782 - RNA, 20 nt, Artificial Sequence
  mmSKRIPTE0007561_H2-Q2_9
  gRNA
uauaaaguccaugcagccaa

SEQ ID NO: 136783 - RNA, 20 nt, Artificial Sequence
  mmSKRIPTE0007562_Gm8909_1
  gRNA
agggucuugugagcgacacg

SEQ ID NO: 136784 - RNA, 20 nt, Artificial Sequence
  mmSKRIPTE0007563_Gm8909_2
  gRNA
gcagaucacucgacgcaggu

SEQ ID NO: 136785 - RNA, 20 nt, Artificial Sequence
  mmSKRIPTE0007564_Gm8909_3
  gRNA
gugaaaggaaaaccgguccg

SEQ ID NO: 136786 - RNA, 20 nt, Artificial Sequence
  mmSKRIPTE0007565_Gm8909_4
  gRNA
uucgccaggucccgagacag

SEQ ID NO: 136787 - RNA, 20 nt, Artificial Sequence
  mmSKRIPTE0007566_Gm8909_5
  gRNA
gauacugacggagacacgcg

SEQ ID NO: 136788 - RNA, 20 nt, Artificial Sequence
  mmSKRIPTE0007567_Gm8909_6
  gRNA
aagcgaacugccaguacccg

SEQ ID NO: 136789 - RNA, 20 nt, Artificial Sequence
  mmSKRIPTE0007568_Gm8909_7
  gRNA
aagucccaccacucaugcaa

SEQ ID NO: 136790 - RNA, 20 nt, Artificial Sequence
  mmSKRIPTE0007569_Gm8909_8
  gRNA
augugcaguucuuuagugag

SEQ ID NO: 136791 - RNA, 20 nt, Artificial Sequence
  mmSKRIPTE0007570_Gm8909_9
  gRNA
uuggagucccuggauggacg

SEQ ID NO: 136792 - RNA, 20 nt, Artificial Sequence
  mmSKRIPTE0007571_Fzd8_1
  gRNA
acacgcucaccaugggcgcg

SEQ ID NO: 136793 - RNA, 20 nt, Artificial Sequence
  mmSKRIPTE0007572_Fzd8_2
  gRNA
acgucaguaccggccugacg

SEQ ID NO: 136794 - RNA, 20 nt, Artificial Sequence
  mmSKRIPTE0007573_Fzd8_3
  gRNA
aauuagcuucgucuugacag

SEQ ID NO: 136795 - RNA, 20 nt, Artificial Sequence
  mmSKRIPTE0007574_Fzd8_4
  gRNA
agcgcuuuaaguacccggaa

SEQ ID NO: 136796 - RNA, 20 nt, Artificial Sequence
  mmSKRIPTE0007575_Fzd8_5
  gRNA
uacaccgcagacuucaucca

SEQ ID NO: 136797 - RNA, 20 nt, Artificial Sequence
  mmSKRIPTE0007576_Fzd8_6
  gRNA
cagagccuugacaaccuacg

SEQ ID NO: 136798 - RNA, 20 nt, Artificial Sequence
  mmSKRIPTE0007577_Fzd8_7
  gRNA
caugcccucauacacccuag

SEQ ID NO: 136799 - RNA, 20 nt, Artificial Sequence
  mmSKRIPTE0007578_Fzd8_8
  gRNA
ugacgcgguuguagagcggg

SEQ ID NO: 136800 - RNA, 20 nt, Artificial Sequence
  mmSKRIPTE0007579_Fzd8_9
  gRNA
gcggugcuacagcgcucuag

SEQ ID NO: 136801 - RNA, 20 nt, Artificial Sequence
  mmSKRIPTE0007580_Mul1_1
  gRNA
aggugguugcgacguuacug

SEQ ID NO: 136802 - RNA, 20 nt, Artificial Sequence
  mmSKRIPTE0007581_Mul1_2
  gRNA
aaggaacugaggccacaucg

SEQ ID NO: 136803 - RNA, 20 nt, Artificial Sequence
  mmSKRIPTE0007582_Mul1_3
  gRNA
aagaacgucuagaaacccgg

SEQ ID NO: 136804 - RNA, 20 nt, Artificial Sequence
  mmSKRIPTE0007583_Mul1_4
  gRNA
aauaacguccagugacacug

SEQ ID NO: 136805 - RNA, 20 nt, Artificial Sequence
  mmSKRIPTE0007584_Mul1_5
  gRNA
cagacgacgcgcagccagag

SEQ ID NO: 136806 - RNA, 20 nt, Artificial Sequence
  mmSKRIPTE0007585_Mul1_6
  gRNA
ggucgcaggugauuucgagg

SEQ ID NO: 136807 - RNA, 20 nt, Artificial Sequence
  mmSKRIPTE0007586_Mul1_7
  gRNA
gugaaggugccacuccacac

SEQ ID NO: 136808 - RNA, 20 nt, Artificial Sequence
  mmSKRIPTE0007587_Mul1_8
  gRNA
uuaacagcgacaagccagug

SEQ ID NO: 136809 - RNA, 20 nt, Artificial Sequence
  mmSKRIPTE0007588_Mul1_9
  gRNA
cuacugcucgucacacgcug

SEQ ID NO: 136810 - RNA, 20 nt, Artificial Sequence
  mmSKRIPTE0007589_Bmx_1
  gRNA
ucccuauggagacugcacca

SEQ ID NO: 136811 - RNA, 20 nt, Artificial Sequence
  mmSKRIPTE0007590_Bmx_2
  gRNA
augcaguuauguuaagccgu

SEQ ID NO: 136812 - RNA, 20 nt, Artificial Sequence
  mmSKRIPTE0007591_Bmx_3
  gRNA
auauagcguauguugcuggu

SEQ ID NO: 136813 - RNA, 20 nt, Artificial Sequence
  mmSKRIPTE0007592_Bmx_4
  gRNA
ucagaagauugcacuuacgu

SEQ ID NO: 136814 - RNA, 20 nt, Artificial Sequence
  mmSKRIPTE0007593_Bmx_5
  gRNA
aacgucuggagggagacuaa

SEQ ID NO: 136815 - RNA, 20 nt, Artificial Sequence
  mmSKRIPTE0007594_Bmx_6
  gRNA
ggaucccuguagugcauccg

SEQ ID NO: 136816 - RNA, 20 nt, Artificial Sequence
  mmSKRIPTE0007595_Bmx_7
  gRNA
ugcaggccuuagcugaacua

SEQ ID NO: 136817 - RNA, 20 nt, Artificial Sequence
  mmSKRIPTE0007596_Bmx_8
  gRNA
ucucagacuuuggaaugacg

SEQ ID NO: 136818 - RNA, 20 nt, Artificial Sequence
  mmSKRIPTE0007597_Bmx_9
  gRNA
uucuuggacaguauuaccug

SEQ ID NO: 136819 - RNA, 20 nt, Artificial Sequence
  mmSKRIPTE0007598_Hspd1_1
  gRNA
agaguacauguagcaaucgg

SEQ ID NO: 136820 - RNA, 20 nt, Artificial Sequence
  mmSKRIPTE0007599_Hspd1_2
  gRNA
ccaacggugcuucaaaacau

SEQ ID NO: 136821 - RNA, 20 nt, Artificial Sequence
  mmSKRIPTE0007600_Hspd1_3
  gRNA
cacacgugaugaaaccagcg

SEQ ID NO: 136822 - RNA, 20 nt, Artificial Sequence
  mmSKRIPTE0007601_Hspd1_4
  gRNA
caaguggcgucauuuccggg

SEQ ID NO: 136823 - RNA, 20 nt, Artificial Sequence
  mmSKRIPTE0007602_Hspd1_5
  gRNA
gaagguucuagaacggaccg

SEQ ID NO: 136824 - RNA, 20 nt, Artificial Sequence
  mmSKRIPTE0007603_Hspd1_6
  gRNA
gguggcaucuguuaguacca

SEQ ID NO: 136825 - RNA, 20 nt, Artificial Sequence
  mmSKRIPTE0007604_Hspd1_7
  gRNA
guaucgugauacugguucug

SEQ ID NO: 136826 - RNA, 20 nt, Artificial Sequence
  mmSKRIPTE0007605_Hspd1_8
  gRNA
gaggggacucgggcucauug

SEQ ID NO: 136827 - RNA, 20 nt, Artificial Sequence
  mmSKRIPTE0007606_Hspd1_9
  gRNA
uuucacccacgggacgcgcg

SEQ ID NO: 136828 - RNA, 20 nt, Artificial Sequence
  mmSKRIPTE0007607_Fzd7_1
  gRNA
aggaaaaagacgaggcgcug

SEQ ID NO: 136829 - RNA, 20 nt, Artificial Sequence
  mmSKRIPTE0007608_Fzd7_2
  gRNA
cgcaccguuacgucucggcg

SEQ ID NO: 136830 - RNA, 20 nt, Artificial Sequence
  mmSKRIPTE0007609_Fzd7_3
  gRNA
gcacggaauccgaagcgccg

SEQ ID NO: 136831 - RNA, 20 nt, Artificial Sequence
  mmSKRIPTE0007610_Fzd7_4
  gRNA
gccgaccuuccuaggacuga

SEQ ID NO: 136832 - RNA, 20 nt, Artificial Sequence
  mmSKRIPTE0007611_Fzd7_5
  gRNA
auggaccggcuagggccuaa

SEQ ID NO: 136833 - RNA, 20 nt, Artificial Sequence
  mmSKRIPTE0007612_Fzd7_6
  gRNA
cucggacgauggcuaccgca

SEQ ID NO: 136834 - RNA, 20 nt, Artificial Sequence
  mmSKRIPTE0007613_Fzd7_7
  gRNA
cuucacgcuaggacucuagc

SEQ ID NO: 136835 - RNA, 20 nt, Artificial Sequence
  mmSKRIPTE0007614_Fzd7_8
  gRNA
ugucacauaguaccuuagcg

SEQ ID NO: 136836 - RNA, 20 nt, Artificial Sequence
  mmSKRIPTE0007615_Fzd7_9
  gRNA
aaggcggagcagcaccaccg

SEQ ID NO: 136837 - RNA, 20 nt, Artificial Sequence
  mmSKRIPTE0007616_Irf1_1
  gRNA
gcuaccaagaggccccgcag

SEQ ID NO: 136838 - RNA, 20 nt, Artificial Sequence
  mmSKRIPTE0007617_Irf1_2
  gRNA
gggugcguuuagaugccaag

SEQ ID NO: 136839 - RNA, 20 nt, Artificial Sequence
  mmSKRIPTE0007618_Irf1_3
  gRNA
gccguggaacaaaaggcgca

SEQ ID NO: 136840 - RNA, 20 nt, Artificial Sequence
  mmSKRIPTE0007619_Irf1_4
  gRNA
ggccaaccuccuaccaugag

SEQ ID NO: 136841 - RNA, 20 nt, Artificial Sequence
  mmSKRIPTE0007620_Irf1_5
  gRNA
cuuugcauauuacauccggg

SEQ ID NO: 136842 - RNA, 20 nt, Artificial Sequence
  mmSKRIPTE0007621_Irf1_6
  gRNA
aaggcuguauaaguaaggaa

SEQ ID NO: 136843 - RNA, 20 nt, Artificial Sequence
  mmSKRIPTE0007622_Irf1_7
  gRNA
cuuuguaucggccuacagga

SEQ ID NO: 136844 - RNA, 20 nt, Artificial Sequence
  mmSKRIPTE0007623_Irf1_8
  gRNA
ccuagaagccucuuaccucg

SEQ ID NO: 136845 - RNA, 20 nt, Artificial Sequence
  mmSKRIPTE0007624_Irf1_9
  gRNA
aagcccaguaguucacgacc

SEQ ID NO: 136846 - RNA, 20 nt, Artificial Sequence
  mmSKRIPTE0007625_Cdk13_1
  gRNA
cguuagugacuacuaaacgg

SEQ ID NO: 136847 - RNA, 20 nt, Artificial Sequence
  mmSKRIPTE0007626_Cdk13_2
  gRNA
aagcauucaguacgacugug

SEQ ID NO: 136848 - RNA, 20 nt, Artificial Sequence
  mmSKRIPTE0007627_Cdk13_3
  gRNA
cacaguuacauagcaaacga

SEQ ID NO: 136849 - RNA, 20 nt, Artificial Sequence
  mmSKRIPTE0007628_Cdk13_4
  gRNA
ugacugggggaaacgcugcg

SEQ ID NO: 136850 - RNA, 20 nt, Artificial Sequence
  mmSKRIPTE0007629_Cdk13_5
  gRNA
agguaauggcgguaacguag

SEQ ID NO: 136851 - RNA, 20 nt, Artificial Sequence
  mmSKRIPTE0007630_Cdk13_6
  gRNA
uggaucgaauaacugaagag

SEQ ID NO: 136852 - RNA, 20 nt, Artificial Sequence
  mmSKRIPTE0007631_Cdk13_7
  gRNA
ucuuugauuucaccauagcg

SEQ ID NO: 136853 - RNA, 20 nt, Artificial Sequence
  mmSKRIPTE0007632_Cdk13_8
  gRNA
auaagucgagugcagcugcg

SEQ ID NO: 136854 - RNA, 20 nt, Artificial Sequence
  mmSKRIPTE0007633_Cdk13_9
  gRNA
uagucgcccauauacuaaca

SEQ ID NO: 136855 - RNA, 20 nt, Artificial Sequence
  mmSKRIPTE0007634_Rab3c_1
  gRNA
gcgaagaauagguugucgaa

SEQ ID NO: 136856 - RNA, 20 nt, Artificial Sequence
  mmSKRIPTE0007635_Rab3c_2
  gRNA
cggguugucucaaccgagag

SEQ ID NO: 136857 - RNA, 20 nt, Artificial Sequence
  mmSKRIPTE0007636_Rab3c_3
  gRNA
agcuggaggggcuagcccga

SEQ ID NO: 136858 - RNA, 20 nt, Artificial Sequence
  mmSKRIPTE0007637_Rab3c_4
  gRNA
uuugccuacaaugagacacg

SEQ ID NO: 136859 - RNA, 20 nt, Artificial Sequence
  mmSKRIPTE0007638_Rab3c_5
  gRNA
uaaaggaaucgucggcauaa

SEQ ID NO: 136860 - RNA, 20 nt, Artificial Sequence
  mmSKRIPTE0007639_Rab3c_6
  gRNA
cacgcgugcggaguguugcg

SEQ ID NO: 136861 - RNA, 20 nt, Artificial Sequence
  mmSKRIPTE0007640_Rab3c_7
  gRNA
auggucucggagaaacugag

SEQ ID NO: 136862 - RNA, 20 nt, Artificial Sequence
  mmSKRIPTE0007641_Rab3c_8
  gRNA
aaauccuuguaagaaucuga

SEQ ID NO: 136863 - RNA, 20 nt, Artificial Sequence
  mmSKRIPTE0007642_Rab3c_9
  gRNA
ccuuggcucagggcacaagu

SEQ ID NO: 136864 - RNA, 20 nt, Artificial Sequence
  mmSKRIPTE0007643_Pou1f1_1
  gRNA
gcaaauauagaucaccagug

SEQ ID NO: 136865 - RNA, 20 nt, Artificial Sequence
  mmSKRIPTE0007644_Pou1f1_2
  gRNA
uaguaaguuaaggaucgcaa

SEQ ID NO: 136866 - RNA, 20 nt, Artificial Sequence
  mmSKRIPTE0007645_Pou1f1_3
  gRNA
agaaagaaguaguacgagug

SEQ ID NO: 136867 - RNA, 20 nt, Artificial Sequence
  mmSKRIPTE0007646_Pou1f1_4
  gRNA
gacugguaagaaaauguacg

SEQ ID NO: 136868 - RNA, 20 nt, Artificial Sequence
  mmSKRIPTE0007647_Pou1f1_5
  gRNA
acuuggaggacacgcaugag

SEQ ID NO: 136869 - RNA, 20 nt, Artificial Sequence
  mmSKRIPTE0007648_Pou1f1_6
  gRNA
uuccuaucaacccuucucag

SEQ ID NO: 136870 - RNA, 20 nt, Artificial Sequence
  mmSKRIPTE0007649_Pou1f1_7
  gRNA
cgugcagaucaguagcacag

SEQ ID NO: 136871 - RNA, 20 nt, Artificial Sequence
  mmSKRIPTE0007650_Pou1f1_8
  gRNA
agaaggugggagcaaacgaa

SEQ ID NO: 136872 - RNA, 20 nt, Artificial Sequence
  mmSKRIPTE0007651_Pou1f1_9
  gRNA
cauccuuagcagcuacacug

SEQ ID NO: 136873 - RNA, 20 nt, Artificial Sequence
  mmSKRIPTE0007652_Ttbk1_1
  gRNA
acuguggcaucucgacaaca

SEQ ID NO: 136874 - RNA, 20 nt, Artificial Sequence
  mmSKRIPTE0007653_Ttbk1_2
  gRNA
gagcauugaccgaggcguag

SEQ ID NO: 136875 - RNA, 20 nt, Artificial Sequence
  mmSKRIPTE0007654_Ttbk1_3
  gRNA
ucagcugcaaucugucgcug

SEQ ID NO: 136876 - RNA, 20 nt, Artificial Sequence
  mmSKRIPTE0007655_Ttbk1_4
  gRNA
caagcauacaaauaagcucg

SEQ ID NO: 136877 - RNA, 20 nt, Artificial Sequence
  mmSKRIPTE0007656_Ttbk1_5
  gRNA
gugagguccccacagcugcg

SEQ ID NO: 136878 - RNA, 20 nt, Artificial Sequence
  mmSKRIPTE0007657_Ttbk1_6
  gRNA
ucaguggagaacgcaaucag

SEQ ID NO: 136879 - RNA, 20 nt, Artificial Sequence
  mmSKRIPTE0007658_Ttbk1_7
  gRNA
cguccuuaagagcugccgcu

SEQ ID NO: 136880 - RNA, 20 nt, Artificial Sequence
  mmSKRIPTE0007659_Ttbk1_8
  gRNA
gagcacgcuguggaugucgg

SEQ ID NO: 136881 - RNA, 20 nt, Artificial Sequence
  mmSKRIPTE0007660_Ttbk1_9
  gRNA
augugacaagaguccacggg

SEQ ID NO: 136882 - RNA, 20 nt, Artificial Sequence
  mmSKRIPTE0007661_Trbc2_1
  gRNA
ucagagucaaggugucaacg

SEQ ID NO: 136883 - RNA, 20 nt, Artificial Sequence
  mmSKRIPTE0007662_Trbc2_2
  gRNA
auggccaugguaagaauggu

SEQ ID NO: 136884 - RNA, 20 nt, Artificial Sequence
  mmSKRIPTE0007663_Trbc2_3
  gRNA
uggauauaaagggaucucag

SEQ ID NO: 136885 - RNA, 20 nt, Artificial Sequence
  mmSKRIPTE0007664_Trbc2_4
  gRNA
uuggaggaucuaaaguacac

SEQ ID NO: 136886 - RNA, 20 nt, Artificial Sequence
  mmSKRIPTE0007665_Trbc2_5
  gRNA
caaauauccuauagacauga

SEQ ID NO: 136887 - RNA, 20 nt, Artificial Sequence
  mmSKRIPTE0007666_Trbc2_6
  gRNA
aacagcauccuaucaucagg

SEQ ID NO: 136888 - RNA, 20 nt, Artificial Sequence
  mmSKRIPTE0007667_Trbc2_7
  gRNA
auccucuggaaaguaaagag

SEQ ID NO: 136889 - RNA, 20 nt, Artificial Sequence
  mmSKRIPTE0007668_Trbc2_8
  gRNA
agguaagugcggagcucaug

SEQ ID NO: 136890 - RNA, 20 nt, Artificial Sequence
  mmSKRIPTE0007669_Trbc2_9
  gRNA
ucuauggccagggugaagaa

SEQ ID NO: 136891 - RNA, 20 nt, Artificial Sequence
  mmSKRIPTE0007670_Fes_1
  gRNA
ugagccugaagaccgcauca

SEQ ID NO: 136892 - RNA, 20 nt, Artificial Sequence
  mmSKRIPTE0007671_Fes_2
  gRNA
ugagcagcugugguaccacg

SEQ ID NO: 136893 - RNA, 20 nt, Artificial Sequence
  mmSKRIPTE0007672_Fes_3
  gRNA
cuuaagggcagugaaucgga

SEQ ID NO: 136894 - RNA, 20 nt, Artificial Sequence
  mmSKRIPTE0007673_Fes_4
  gRNA
agcucguucaaggugagcag

SEQ ID NO: 136895 - RNA, 20 nt, Artificial Sequence
  mmSKRIPTE0007674_Fes_5
  gRNA
auugcaggggaacuucggag

SEQ ID NO: 136896 - RNA, 20 nt, Artificial Sequence
  mmSKRIPTE0007675_Fes_6
  gRNA
acacguggguagcgugacag

SEQ ID NO: 136897 - RNA, 20 nt, Artificial Sequence
  mmSKRIPTE0007676_Fes_7
  gRNA
ccuucgugcagacaauaccc

SEQ ID NO: 136898 - RNA, 20 nt, Artificial Sequence
  mmSKRIPTE0007677_Fes_8
  gRNA
aauagcgacuaccaaccccu

SEQ ID NO: 136899 - RNA, 20 nt, Artificial Sequence
  mmSKRIPTE0007678_Fes_9
  gRNA
gcgacaagccugucuacaca

SEQ ID NO: 136900 - RNA, 20 nt, Artificial Sequence
  mmSKRIPTE0007679_Prkx_1
  gRNA
ccuauuguuacucacccgcg

SEQ ID NO: 136901 - RNA, 20 nt, Artificial Sequence
  mmSKRIPTE0007680_Prkx_2
  gRNA
ugggacaccauagccaccgu

SEQ ID NO: 136902 - RNA, 20 nt, Artificial Sequence
  mmSKRIPTE0007681_Prkx_3
  gRNA
ccgucgguuacgcaacaagg

SEQ ID NO: 136903 - RNA, 20 nt, Artificial Sequence
  mmSKRIPTE0007682_Prkx_4
  gRNA
ccgagaccuuggucuucacg

SEQ ID NO: 136904 - RNA, 20 nt, Artificial Sequence
  mmSKRIPTE0007683_Prkx_5
  gRNA
agacacaacagagugcacga

SEQ ID NO: 136905 - RNA, 20 nt, Artificial Sequence
  mmSKRIPTE0007684_Prkx_6
  gRNA
ucggccacgauuacgcaggu

SEQ ID NO: 136906 - RNA, 20 nt, Artificial Sequence
  mmSKRIPTE0007685_Prkx_7
  gRNA
cucccaagagugcgauguag

SEQ ID NO: 136907 - RNA, 20 nt, Artificial Sequence
  mmSKRIPTE0007686_Prkx_8
  gRNA
acuucaccuuagggacucgg

SEQ ID NO: 136908 - RNA, 20 nt, Artificial Sequence
  mmSKRIPTE0007687_Prkx_9
  gRNA
auggacaucaugccaaucug

SEQ ID NO: 136909 - RNA, 20 nt, Artificial Sequence
  mmSKRIPTE0007688_Cacuin_1
  gRNA
ccaagugucacccauuggcg

SEQ ID NO: 136910 - RNA, 20 nt, Artificial Sequence
  mmSKRIPTE0007689_Cacuin_2
  gRNA
cgggacgccguuagaacuag

SEQ ID NO: 136911 - RNA, 20 nt, Artificial Sequence
  mmSKRIPTE0007690_Cacuin_3
  gRNA
ugucuuaacgggacuccccg

SEQ ID NO: 136912 - RNA, 20 nt, Artificial Sequence
  mmSKRIPTE0007691_Cacuin_4
  gRNA
uucaaccggggaaccccgug

SEQ ID NO: 136913 - RNA, 20 nt, Artificial Sequence
  mmSKRIPTE0007692_Cacuin_5
  gRNA
cgugugccgugagcagccgu

SEQ ID NO: 136914 - RNA, 20 nt, Artificial Sequence
  mmSKRIPTE0007693_Cacuin_6
  gRNA
gugucuccuaaggagccuca

SEQ ID NO: 136915 - RNA, 20 nt, Artificial Sequence
  mmSKRIPTE0007694_Cacuin_7
  gRNA
ucccacaggucagauucgga

SEQ ID NO: 136916 - RNA, 20 nt, Artificial Sequence
  mmSKRIPTE0007695_Cacuin_8
  gRNA
aggccuccuucagaagccgu

SEQ ID NO: 136917 - RNA, 20 nt, Artificial Sequence
  mmSKRIPTE0007696_Cacuin_9
  gRNA
caagaucgucagucgugagu

SEQ ID NO: 136918 - RNA, 20 nt, Artificial Sequence
  mmSKRIPTE0007697_Aimp1_1
  gRNA
agguuucucugccgauucug

SEQ ID NO: 136919 - RNA, 20 nt, Artificial Sequence
  mmSKRIPTE0007698_Aimp1_2
  gRNA
gcuauggagaggacccgggu

SEQ ID NO: 136920 - RNA, 20 nt, Artificial Sequence
  mmSKRIPTE0007699_Aimp1_3
  gRNA
ugaaucaaaagggggcacgu

SEQ ID NO: 136921 - RNA, 20 nt, Artificial Sequence
  mmSKRIPTE0007700_Aimp1_4
  gRNA
acguuacaggacuaacaccc

SEQ ID NO: 136922 - RNA, 20 nt, Artificial Sequence
  mmSKRIPTE0007701_Aimp1_5
  gRNA
cuagccgagaggcaacgacu

SEQ ID NO: 136923 - RNA, 20 nt, Artificial Sequence
  mmSKRIPTE0007702_Aimp1_6
  gRNA
ugaauguugacgccauugag

SEQ ID NO: 136924 - RNA, 20 nt, Artificial Sequence
  mmSKRIPTE0007703_Aimp1_7
  gRNA
uccagacgcgaugcgucgau

SEQ ID NO: 136925 - RNA, 20 nt, Artificial Sequence
  mmSKRIPTE0007704_Aimp1_8
  gRNA
auguggcguuaugcucacug

SEQ ID NO: 136926 - RNA, 20 nt, Artificial Sequence
  mmSKRIPTE0007705_Aimp1_9
  gRNA
ggcaaugaauacguggccga

SEQ ID NO: 136927 - RNA, 20 nt, Artificial Sequence
  mmSKRIPTE0007706_Tcf7_1
  gRNA
guuuguuuagaaccacccua

SEQ ID NO: 136928 - RNA, 20 nt, Artificial Sequence
  mmSKRIPTE0007707_Tcf7_2
  gRNA
gcucaggcacugaaacguug

SEQ ID NO: 136929 - RNA, 20 nt, Artificial Sequence
  mmSKRIPTE0007708_Tcf7_3
  gRNA
uauacccgggcugguccgcg

SEQ ID NO: 136930 - RNA, 20 nt, Artificial Sequence
  mmSKRIPTE0007709_Tcf7_4
  gRNA
cuugcccaguuaacauccag

SEQ ID NO: 136931 - RNA, 20 nt, Artificial Sequence
  mmSKRIPTE0007710_Tcf7_5
  gRNA
gcugucugggccuagcaaug

SEQ ID NO: 136932 - RNA, 20 nt, Artificial Sequence
  mmSKRIPTE0007711_Tcf7_6
  gRNA
ugcaaaccacgugugcaggu

SEQ ID NO: 136933 - RNA, 20 nt, Artificial Sequence
  mmSKRIPTE0007712_Tcf7_7
  gRNA
gcuucggucacuuaccagcg

SEQ ID NO: 136934 - RNA, 20 nt, Artificial Sequence
  mmSKRIPTE0007713_Tcf7_8
  gRNA
ccucuaguaaaaggaagcgg

SEQ ID NO: 136935 - RNA, 20 nt, Artificial Sequence
  mmSKRIPTE0007714_Tcf7_9
  gRNA
agguagccagccccauuaca

SEQ ID NO: 136936 - RNA, 20 nt, Artificial Sequence
  mmSKRIPTE0007715_Il25_1
  gRNA
uggcccugcaggauucugcg

SEQ ID NO: 136937 - RNA, 20 nt, Artificial Sequence
  mmSKRIPTE0007716_Il25_2
  gRNA
uacucaggaacggacuccaa

SEQ ID NO: 136938 - RNA, 20 nt, Artificial Sequence
  mmSKRIPTE0007717_Il25_3
  gRNA
accagacggucuucuaccgg

SEQ ID NO: 136939 - RNA, 20 nt, Artificial Sequence
  mmSKRIPTE0007718_Il25_4
  gRNA
auguucucauggauccccca

SEQ ID NO: 136940 - RNA, 20 nt, Artificial Sequence
  mmSKRIPTE0007719_Il25_5
  gRNA
caaagagcaagaacccccgg

SEQ ID NO: 136941 - RNA, 20 nt, Artificial Sequence
  mmSKRIPTE0007720_Il25_6
  gRNA
ccaaugagaaagcuacucgc

SEQ ID NO: 136942 - RNA, 20 nt, Artificial Sequence
  mmSKRIPTE0007721_Il25_7
  gRNA
cgucagcuugcggauccagg

SEQ ID NO: 136943 - RNA, 20 nt, Artificial Sequence
  mmSKRIPTE0007722_Il25_8
  gRNA
gauggguaccuuccucgcca

SEQ ID NO: 136944 - RNA, 20 nt, Artificial Sequence
  mmSKRIPTE0007723_Il25_9
  gRNA
caugacuaagccaugacccg

SEQ ID NO: 136945 - RNA, 20 nt, Artificial Sequence
  mmSKRIPTE0007724_Pf4_1
  gRNA
ucuugacaugagcgucgcug

SEQ ID NO: 136946 - RNA, 20 nt, Artificial Sequence
  mmSKRIPTE0007725_Pf4_2
  gRNA
agcaucgccuuccccucgga

SEQ ID NO: 136947 - RNA, 20 nt, Artificial Sequence
  mmSKRIPTE0007726_Pf4_3
  gRNA
gacaucgggucauauuguau

SEQ ID NO: 136948 - RNA, 20 nt, Artificial Sequence
  mmSKRIPTE0007727_Pf4_4
  gRNA
ugagcuggggaaccgcacag

SEQ ID NO: 136949 - RNA, 20 nt, Artificial Sequence
  mmSKRIPTE0007728_Pf4_5
  gRNA
cuggugacagcaaccaccgc

SEQ ID NO: 136950 - RNA, 20 nt, Artificial Sequence
  mmSKRIPTE0007729_Pf4_6
  gRNA
ggaccagcugaggguaaacg

SEQ ID NO: 136951 - RNA, 20 nt, Artificial Sequence
  mmSKRIPTE0007730_Pf4_7
  gRNA
gacccuaucaucugccggug

SEQ ID NO: 136952 - RNA, 20 nt, Artificial Sequence
  mmSKRIPTE0007731_Pf4_8
  gRNA
gaggugaacucugaugacau

SEQ ID NO: 136953 - RNA, 20 nt, Artificial Sequence
  mmSKRIPTE0007732_Pf4_9
  gRNA
gugcuuaagauggaucccag

SEQ ID NO: 136954 - RNA, 20 nt, Artificial Sequence
  mmSKRIPTE0007733_Map2k2_1
  gRNA
gggaaugggauaccucccga

SEQ ID NO: 136955 - RNA, 20 nt, Artificial Sequence
  mmSKRIPTE0007734_Map2k2_2
  gRNA
gaaacaccacagacgucaag

SEQ ID NO: 136956 - RNA, 20 nt, Artificial Sequence
  mmSKRIPTE0007735_Map2k2_3
  gRNA
uggugccugaagugguacag

SEQ ID NO: 136957 - RNA, 20 nt, Artificial Sequence
  mmSKRIPTE0007736_Map2k2_4
  gRNA
cugucaaguaggucauggga

SEQ ID NO: 136958 - RNA, 20 nt, Artificial Sequence
  mmSKRIPTE0007737_Map2k2_5
  gRNA
cuuccuccgggccagcaucg

SEQ ID NO: 136959 - RNA, 20 nt, Artificial Sequence
  mmSKRIPTE0007738_Map2k2_6
  gRNA
uaucaacccuaccaucgccg

SEQ ID NO: 136960 - RNA, 20 nt, Artificial Sequence
  mmSKRIPTE0007739_Map2k2_7
  gRNA
aaccccauagugucuccccg

SEQ ID NO: 136961 - RNA, 20 nt, Artificial Sequence
  mmSKRIPTE0007740_Map2k2_8
  gRNA
aggucagcauugcgguaagu

SEQ ID NO: 136962 - RNA, 20 nt, Artificial Sequence
  mmSKRIPTE0007741_Map2k2_9
  gRNA
ccccacccacuagauagugu

SEQ ID NO: 136963 - RNA, 20 nt, Artificial Sequence
  mmSKRIPTE0007742_Il5_1
  gRNA
cucuugguccagauggacgc

SEQ ID NO: 136964 - RNA, 20 nt, Artificial Sequence
  mmSKRIPTE0007743_Il5_2
  gRNA
ugucaacagagcucggugag

SEQ ID NO: 136965 - RNA, 20 nt, Artificial Sequence
  mmSKRIPTE0007744_Il5_3
  gRNA
ccagucagagcgguauagca

SEQ ID NO: 136966 - RNA, 20 nt, Artificial Sequence
  mmSKRIPTE0007745_Il5_4
  gRNA
acucuguacucaucacacca

SEQ ID NO: 136967 - RNA, 20 nt, Artificial Sequence
  mmSKRIPTE0007746_Il5_5
  gRNA
gagacccugaugcaacgaag

SEQ ID NO: 136968 - RNA, 20 nt, Artificial Sequence
  mmSKRIPTE0007747_Il5_6
  gRNA
aggagcaggaagccccggug

SEQ ID NO: 136969 - RNA, 20 nt, Artificial Sequence
  mmSKRIPTE0007748_Il5_7
  gRNA
aagaaccauagcgucaggca

SEQ ID NO: 136970 - RNA, 20 nt, Artificial Sequence
  mmSKRIPTE0007749_Il5_8
  gRNA
gguaucgggagcaagaacaa

SEQ ID NO: 136971 - RNA, 20 nt, Artificial Sequence
  mmSKRIPTE0007750_Il5_9
  gRNA
auguguuaguguuaaugcac

SEQ ID NO: 136972 - RNA, 20 nt, Artificial Sequence
  mmSKRIPTE0007751_Ccl6_1
  gRNA
uucagauucauagaacuacg

SEQ ID NO: 136973 - RNA, 20 nt, Artificial Sequence
  mmSKRIPTE0007752_Ccl6_2
  gRNA
ucugugccgaccccagcgau

SEQ ID NO: 136974 - RNA, 20 nt, Artificial Sequence
  mmSKRIPTE0007753_Ccl6_3
  gRNA
uuguggcagggcgaacaacu

SEQ ID NO: 136975 - RNA, 20 nt, Artificial Sequence
  mmSKRIPTE0007754_Ccl6_4
  gRNA
auggcucuaaccgugucagg

SEQ ID NO: 136976 - RNA, 20 nt, Artificial Sequence
  mmSKRIPTE0007755_Ccl6_5
  gRNA
cuccuagcuuauaaauacca

SEQ ID NO: 136977 - RNA, 20 nt, Artificial Sequence
  mmSKRIPTE0007756_Ccl6_6
  gRNA
cuugagcccucucaacccag

SEQ ID NO: 136978 - RNA, 20 nt, Artificial Sequence
  mmSKRIPTE0007757_Ccl6_7
  gRNA
uggucccgaagggaguaugg

SEQ ID NO: 136979 - RNA, 20 nt, Artificial Sequence
  mmSKRIPTE0007758_Ccl6_8
  gRNA
cauggaguggacuuuauugg

SEQ ID NO: 136980 - RNA, 20 nt, Artificial Sequence
  mmSKRIPTE0007759_Ccl6_9
  gRNA
uguucaccaaaaccuaaggg

SEQ ID NO: 136981 - RNA, 20 nt, Artificial Sequence
  mmSKRIPTE0007760_Klf11_1
  gRNA
ugcaagagugugguucgaag

SEQ ID NO: 136982 - RNA, 20 nt, Artificial Sequence
  mmSKRIPTE0007761_Klf11_2
  gRNA
gacaugguacccgagccaug

SEQ ID NO: 136983 - RNA, 20 nt, Artificial Sequence
  mmSKRIPTE0007762_Klf11_3
  gRNA
cgcccucuuacacuacuacc

SEQ ID NO: 136984 - RNA, 20 nt, Artificial Sequence
  mmSKRIPTE0007763_Klf11_4
  gRNA
uuacgacggaaugaggagca

SEQ ID NO: 136985 - RNA, 20 nt, Artificial Sequence
  mmSKRIPTE0007764_Klf11_5
  gRNA
agcucacggagccgucaaca

SEQ ID NO: 136986 - RNA, 20 nt, Artificial Sequence
  mmSKRIPTE0007765_Klf11_6
  gRNA
uuugugcacauucggcucug

SEQ ID NO: 136987 - RNA, 20 nt, Artificial Sequence
  mmSKRIPTE0007766_Klf11_7
  gRNA
augacgucacccgaauccag

SEQ ID NO: 136988 - RNA, 20 nt, Artificial Sequence
  mmSKRIPTE0007767_Klf11_8
  gRNA
cagugugauccgucacaccg

SEQ ID NO: 136989 - RNA, 20 nt, Artificial Sequence
  mmSKRIPTE0007768_Klf11_9
  gRNA
augcagaacacccgcucacg

SEQ ID NO: 136990 - RNA, 20 nt, Artificial Sequence
  mmSKRIPTE0007769_Hfe_1
  gRNA
gguuugcuccaagauccacg

SEQ ID NO: 136991 - RNA, 20 nt, Artificial Sequence
  mmSKRIPTE0007770_Hfe_2
  gRNA
auaaccacaguaaggguacg

SEQ ID NO: 136992 - RNA, 20 nt, Artificial Sequence
  mmSKRIPTE0007771_Hfe_3
  gRNA
uucacuaggaucuggaaacg

SEQ ID NO: 136993 - RNA, 20 nt, Artificial Sequence
  mmSKRIPTE0007772_Hfe_4
  gRNA
cgagaaggugcuaccuaacg

SEQ ID NO: 136994 - RNA, 20 nt, Artificial Sequence
  mmSKRIPTE0007773_Hfe_5
  gRNA
uccaaguaucgagugaucug

SEQ ID NO: 136995 - RNA, 20 nt, Artificial Sequence
  mmSKRIPTE0007774_Hfe_6
  gRNA
aaugaauagcaugcucaggg

SEQ ID NO: 136996 - RNA, 20 nt, Artificial Sequence
  mmSKRIPTE0007775_Hfe_7
  gRNA
aggagcguaaugaaguauca

SEQ ID NO: 136997 - RNA, 20 nt, Artificial Sequence
  mmSKRIPTE0007776_Hfe_8
  gRNA
uuccucccgcacucacgcgg

SEQ ID NO: 136998 - RNA, 20 nt, Artificial Sequence
  mmSKRIPTE0007777_Hfe_9
  gRNA
ccuucgaagagagaaacacc

SEQ ID NO: 136999 - RNA, 20 nt, Artificial Sequence
  mmSKRIPTE0007778_Il9_1
  gRNA
ucccucccuguagcacggug

SEQ ID NO: 137000 - RNA, 20 nt, Artificial Sequence
  mmSKRIPTE0007779_Il9_2
  gRNA
gcucccgguguugcauaggu

SEQ ID NO: 137001 - RNA, 20 nt, Artificial Sequence
  mmSKRIPTE0007780_Il9_3
  gRNA
uauagucggaaaaaggucag

SEQ ID NO: 137002 - RNA, 20 nt, Artificial Sequence
  mmSKRIPTE0007781_Il9_4
  gRNA
uuucaggaagaaucgccaag

SEQ ID NO: 137003 - RNA, 20 nt, Artificial Sequence
  mmSKRIPTE0007782_Il9_5
  gRNA
aucuggaauaaagauccacg

SEQ ID NO: 137004 - RNA, 20 nt, Artificial Sequence
  mmSKRIPTE0007783_Il9_6
  gRNA
gaaauaagaagguugauccu

SEQ ID NO: 137005 - RNA, 20 nt, Artificial Sequence
  mmSKRIPTE0007784_Il9_7
  gRNA
acgguggaucauccuacagu

SEQ ID NO: 137006 - RNA, 20 nt, Artificial Sequence
  mmSKRIPTE0007785_Il9_8
  gRNA
cuuaagauaguuuccucggg

SEQ ID NO: 137007 - RNA, 20 nt, Artificial Sequence
  mmSKRIPTE0007786_Il9_9
  gRNA
gucaggcaaaaaauguaacc

SEQ ID NO: 137008 - RNA, 20 nt, Artificial Sequence
  mmSKRIPTE0007787_Pla2g10_1
  gRNA
agaggaccgcaguaacuaug

SEQ ID NO: 137009 - RNA, 20 nt, Artificial Sequence
  mmSKRIPTE0007788_Pla2g10_2
  gRNA
gcagugguaccuuaccacaa

SEQ ID NO: 137010 - RNA, 20 nt, Artificial Sequence
  mmSKRIPTE0007789_Pla2g10_3
  gRNA
agcauuauugcccgucacag

SEQ ID NO: 137011 - RNA, 20 nt, Artificial Sequence
  mmSKRIPTE0007790_Pla2g10_4
  gRNA
aggauuaaagaaucaccaag

SEQ ID NO: 137012 - RNA, 20 nt, Artificial Sequence
  mmSKRIPTE0007791_Pla2g10_5
  gRNA
uugugcaggagagucaccgg

SEQ ID NO: 137013 - RNA, 20 nt, Artificial Sequence
  mmSKRIPTE0007792_Pla2g10_6
  gRNA
ugaacaaccuaaaaguccau

SEQ ID NO: 137014 - RNA, 20 nt, Artificial Sequence
  mmSKRIPTE0007793_Pla2g10_7
  gRNA
caccagucaauggcgucacg

SEQ ID NO: 137015 - RNA, 20 nt, Artificial Sequence
  mmSKRIPTE0007794_Pla2g10_8
  gRNA
uuagaggcacuggcccaaga

SEQ ID NO: 137016 - RNA, 20 nt, Artificial Sequence
  mmSKRIPTE0007795_Pla2g10_9
  gRNA
ucuguacccagguaaggccg

SEQ ID NO: 137017 - RNA, 20 nt, Artificial Sequence
  mmSKRIPTE0007796_Mx1_1
  gRNA
uauauggaaaggcaccccga

SEQ ID NO: 137018 - RNA, 20 nt, Artificial Sequence
  mmSKRIPTE0007797_Mx1_2
  gRNA
accaaacacagguaucaccu

SEQ ID NO: 137019 - RNA, 20 nt, Artificial Sequence
  mmSKRIPTE0007798_Mx1_3
  gRNA
aguacacugaauaccacacg

SEQ ID NO: 137020 - RNA, 20 nt, Artificial Sequence
  mmSKRIPTE0007799_Mx1_4
  gRNA
accagaagccgacccuucug

SEQ ID NO: 137021 - RNA, 20 nt, Artificial Sequence
  mmSKRIPTE0007800_Mx1_5
  gRNA
ugaucaccaacucuacggag

SEQ ID NO: 137022 - RNA, 20 nt, Artificial Sequence
  mmSKRIPTE0007801_Mx1_6
  gRNA
uucacagaauccuagaugag

SEQ ID NO: 137023 - RNA, 20 nt, Artificial Sequence
  mmSKRIPTE0007802_Mx1_7
  gRNA
uccacccuuccugauagggg

SEQ ID NO: 137024 - RNA, 20 nt, Artificial Sequence
  mmSKRIPTE0007803_Mx1_8
  gRNA
ucucaauggcugaucuacag

SEQ ID NO: 137025 - RNA, 20 nt, Artificial Sequence
  mmSKRIPTE0007804_Mx1_9
  gRNA
gugagaaacaucacucucac

SEQ ID NO: 137026 - RNA, 20 nt, Artificial Sequence
  mmSKRIPTE0007805_H2-M2_1
  gRNA
gacaucgcagugucaagacc

SEQ ID NO: 137027 - RNA, 20 nt, Artificial Sequence
  mmSKRIPTE0007806_H2-M2_2
  gRNA
aaggugaccuagccuagggu

SEQ ID NO: 137028 - RNA, 20 nt, Artificial Sequence
  mmSKRIPTE0007807_H2-M2_3
  gRNA
caguggcuacucuugucaug

SEQ ID NO: 137029 - RNA, 20 nt, Artificial Sequence
  mmSKRIPTE0007808_H2-M2_4
  gRNA
cagaacagugaguaacccug

SEQ ID NO: 137030 - RNA, 20 nt, Artificial Sequence
  mmSKRIPTE0007809_H2-M2_5
  gRNA
cuacugcgcacagguacgag

SEQ ID NO: 137031 - RNA, 20 nt, Artificial Sequence
  mmSKRIPTE0007810_H2-M2_6
  gRNA
ugucgaaguaccgcaaggag

SEQ ID NO: 137032 - RNA, 20 nt, Artificial Sequence
  mmSKRIPTE0007811_H2-M2_7
  gRNA
uccucauuauauagucacca

SEQ ID NO: 137033 - RNA, 20 nt, Artificial Sequence
  mmSKRIPTE0007812_H2-M2_8
  gRNA
auagccaacagucauguagu

SEQ ID NO: 137034 - RNA, 20 nt, Artificial Sequence
  mmSKRIPTE0007813_H2-M2_9
  gRNA
accugcccuggauccccaug

SEQ ID NO: 137035 - RNA, 20 nt, Artificial Sequence
  mmSKRIPTE0007814_Nbl1_1
  gRNA
accggccagacuuucgagca

SEQ ID NO: 137036 - RNA, 20 nt, Artificial Sequence
  mmSKRIPTE0007815_Nbl1_2
  gRNA
ugcgggucgccggagcaaag

SEQ ID NO: 137037 - RNA, 20 nt, Artificial Sequence
  mmSKRIPTE0007816_Nbl1_3
  gRNA
gaggugcaguauagccucgg

SEQ ID NO: 137038 - RNA, 20 nt, Artificial Sequence
  mmSKRIPTE0007817_Nbl1_4
  gRNA
agggaccaggauagauccag

SEQ ID NO: 137039 - RNA, 20 nt, Artificial Sequence
  mmSKRIPTE0007818_Nbl1_5
  gRNA
cgccgggcugcguaacacga

SEQ ID NO: 137040 - RNA, 20 nt, Artificial Sequence
  mmSKRIPTE0007819_Nbl1_6
  gRNA
ccuuugcugaaggaccuaug

SEQ ID NO: 137041 - RNA, 20 nt, Artificial Sequence
  mmSKRIPTE0007820_Nbl1_7
  gRNA
caucucucuagaaggccgaa

SEQ ID NO: 137042 - RNA, 20 nt, Artificial Sequence
  mmSKRIPTE0007821_Nbl1_8
  gRNA
aaagugaaaaucgaggcgag

SEQ ID NO: 137043 - RNA, 20 nt, Artificial Sequence
  mmSKRIPTE0007822_Nbl1_9
  gRNA
aaaguggggugcgagccgcg

SEQ ID NO: 137044 - RNA, 20 nt, Artificial Sequence
  mmSKRIPTE0007823_Gper1_1
  gRNA
ugugaaucuuaccugugccg

SEQ ID NO: 137045 - RNA, 20 nt, Artificial Sequence
  mmSKRIPTE0007824_Gper1_2
  gRNA
cauguuacaugccugcuacg

SEQ ID NO: 137046 - RNA, 20 nt, Artificial Sequence
  mmSKRIPTE0007825_Gper1_3
  gRNA
caaauccugaaaacugccga

SEQ ID NO: 137047 - RNA, 20 nt, Artificial Sequence
  mmSKRIPTE0007826_Gper1_4
  gRNA
agcggugcaccugcggcaca

SEQ ID NO: 137048 - RNA, 20 nt, Artificial Sequence
  mmSKRIPTE0007827_Gper1_5
  gRNA
agaucuaccuaggucccgug

SEQ ID NO: 137049 - RNA, 20 nt, Artificial Sequence
  mmSKRIPTE0007828_Gper1_6
  gRNA
ggaugccgccauaagaugug

SEQ ID NO: 137050 - RNA, 20 nt, Artificial Sequence
  mmSKRIPTE0007829_Gper1_7
  gRNA
cacugcgggaagaugccccg

SEQ ID NO: 137051 - RNA, 20 nt, Artificial Sequence
  mmSKRIPTE0007830_Gper1_8
  gRNA
ggggaagacgucacauugcg

SEQ ID NO: 137052 - RNA, 20 nt, Artificial Sequence
  mmSKRIPTE0007831_Gper1_9
  gRNA
ugacggccuugagcguggca

SEQ ID NO: 137053 - RNA, 20 nt, Artificial Sequence
  mmSKRIPTE0007832_Lep_1
  gRNA
agucgguauccgccaagcag

SEQ ID NO: 137054 - RNA, 20 nt, Artificial Sequence
  mmSKRIPTE0007833_Lep_2
  gRNA
cguggguacacgcuucgcug

SEQ ID NO: 137055 - RNA, 20 nt, Artificial Sequence
  mmSKRIPTE0007834_Lep_3
  gRNA
ugcaauaguccccagacgug

SEQ ID NO: 137056 - RNA, 20 nt, Artificial Sequence
  mmSKRIPTE0007835_Lep_4
  gRNA
cugugguuagacccuacuca

SEQ ID NO: 137057 - RNA, 20 nt, Artificial Sequence
  mmSKRIPTE0007836_Lep_5
  gRNA
agguucacagauguaaugaa

SEQ ID NO: 137058 - RNA, 20 nt, Artificial Sequence
  mmSKRIPTE0007837_Lep_6
  gRNA
gcggcugaaguucucccucg

SEQ ID NO: 137059 - RNA, 20 nt, Artificial Sequence
  mmSKRIPTE0007838_Lep_7
  gRNA
aacucccaagcagcacacga

SEQ ID NO: 137060 - RNA, 20 nt, Artificial Sequence
  mmSKRIPTE0007839_Lep_8
  gRNA
cagcugcaagguaaggcccg

SEQ ID NO: 137061 - RNA, 20 nt, Artificial Sequence
  mmSKRIPTE0007840_Lep_9
  gRNA
aaccuuggagaucuacacca

SEQ ID NO: 137062 - RNA, 20 nt, Artificial Sequence
  mmSKRIPTE0007841_Lag3_1
  gRNA
guuucagcuaaaaaaugacg

SEQ ID NO: 137063 - RNA, 20 nt, Artificial Sequence
  mmSKRIPTE0007842_Lag3_2
  gRNA
accccuguccccacuuccgu

SEQ ID NO: 137064 - RNA, 20 nt, Artificial Sequence
  mmSKRIPTE0007843_Lag3_3
  gRNA
cgcgggguuucgcuucgcag

SEQ ID NO: 137065 - RNA, 20 nt, Artificial Sequence
  mmSKRIPTE0007844_Lag3_4
  gRNA
gauccuaacuuucuacgaag

SEQ ID NO: 137066 - RNA, 20 nt, Artificial Sequence
  mmSKRIPTE0007845_Lag3_5
  gRNA
ccgggagccagguaacccga

SEQ ID NO: 137067 - RNA, 20 nt, Artificial Sequence
  mmSKRIPTE0007846_Lag3_6
  gRNA
ccguuaccaaggguaagcag

SEQ ID NO: 137068 - RNA, 20 nt, Artificial Sequence
  mmSKRIPTE0007847_Lag3_7
  gRNA
ggugcggguugucuaggcga

SEQ ID NO: 137069 - RNA, 20 nt, Artificial Sequence
  mmSKRIPTE0007848_Lag3_8
  gRNA
gaaacgcucgccuuuaggcg

SEQ ID NO: 137070 - RNA, 20 nt, Artificial Sequence
  mmSKRIPTE0007849_Lag3_9
  gRNA
uggcagugucagcuguacga

SEQ ID NO: 137071 - RNA, 20 nt, Artificial Sequence
  mmSKRIPTE0007850_Tcim_1
  gRNA
ggggcccuucauaaauccga

SEQ ID NO: 137072 - RNA, 20 nt, Artificial Sequence
  mmSKRIPTE0007851_Tcim_2
  gRNA
acugcggaaauauuccauca

SEQ ID NO: 137073 - RNA, 20 nt, Artificial Sequence
  mmSKRIPTE0007852_Tcim_3
  gRNA
ucuguuguaaaaaucguccc

SEQ ID NO: 137074 - RNA, 20 nt, Artificial Sequence
  mmSKRIPTE0007853_Tcim_4
  gRNA
cgggcuuacucgaagagacg

SEQ ID NO: 137075 - RNA, 20 nt, Artificial Sequence
  mmSKRIPTE0007854_Tcim_5
  gRNA
cuguggugauccguccccaa

SEQ ID NO: 137076 - RNA, 20 nt, Artificial Sequence
  mmSKRIPTE0007855_Tcim_6
  gRNA
ugcgagcggcugugucgaag

SEQ ID NO: 137077 - RNA, 20 nt, Artificial Sequence
  mmSKRIPTE0007856_Tcim_7
  gRNA
acgucacauugaucccaggg

SEQ ID NO: 137078 - RNA, 20 nt, Artificial Sequence
  mmSKRIPTE0007857_Tcim_8
  gRNA
ccggagccagaucuuuggca

SEQ ID NO: 137079 - RNA, 20 nt, Artificial Sequence
  mmSKRIPTE0007858_Tcim_9
  gRNA
gcucgggacucaaauuacac

SEQ ID NO: 137080 - RNA, 20 nt, Artificial Sequence
  mmSKRIPTE0007859_Prdx2_1
  gRNA
cucuucccuagggaaguacg

SEQ ID NO: 137081 - RNA, 20 nt, Artificial Sequence
  mmSKRIPTE0007860_Prdx2_2
  gRNA
aaggacuuaaagcaaggccg

SEQ ID NO: 137082 - RNA, 20 nt, Artificial Sequence
  mmSKRIPTE0007861_Prdx2_3
  gRNA
gauaguagaagucuccccca

SEQ ID NO: 137083 - RNA, 20 nt, Artificial Sequence
  mmSKRIPTE0007862_Prdx2_4
  gRNA
caacgcgcaaaucggaaagu

SEQ ID NO: 137084 - RNA, 20 nt, Artificial Sequence
  mmSKRIPTE0007863_Prdx2_5
  gRNA
auggcuucacuugugcccgu

SEQ ID NO: 137085 - RNA, 20 nt, Artificial Sequence
  mmSKRIPTE0007864_Prdx2_6
  gRNA
uuaggggggcggguauucag

SEQ ID NO: 137086 - RNA, 20 nt, Artificial Sequence
  mmSKRIPTE0007865_Prdx2_7
  gRNA
uggcuaaucacuuucauacg

SEQ ID NO: 137087 - RNA, 20 nt, Artificial Sequence
  mmSKRIPTE0007866_Prdx2_8
  gRNA
gagguaaugccuccaccuug

SEQ ID NO: 137088 - RNA, 20 nt, Artificial Sequence
  mmSKRIPTE0007867_Prdx2_9
  gRNA
cucaguucacccaccuggcg

SEQ ID NO: 137089 - RNA, 20 nt, Artificial Sequence
  mmSKRIPTE0007868_Thy1_1
  gRNA
gggguuugcacucgcccuug

SEQ ID NO: 137090 - RNA, 20 nt, Artificial Sequence
  mmSKRIPTE0007869_Thy1_2
  gRNA
ccgacuuggauucuguggug

SEQ ID NO: 137091 - RNA, 20 nt, Artificial Sequence
  mmSKRIPTE0007870_Thy1_3
  gRNA
gguauucaucaugugcuccg

SEQ ID NO: 137092 - RNA, 20 nt, Artificial Sequence
  mmSKRIPTE0007871_Thy1_4
  gRNA
ccccugagacuauggcaaag

SEQ ID NO: 137093 - RNA, 20 nt, Artificial Sequence
  mmSKRIPTE0007872_Thy1_5
  gRNA
ugugaguggggcaagauuag

SEQ ID NO: 137094 - RNA, 20 nt, Artificial Sequence
  mmSKRIPTE0007873_Thy1_6
  gRNA
cgugugcucggguaucccaa

SEQ ID NO: 137095 - RNA, 20 nt, Artificial Sequence
  mmSKRIPTE0007874_Thy1_7
  gRNA
uggaaguuggagucugcaag

SEQ ID NO: 137096 - RNA, 20 nt, Artificial Sequence
  mmSKRIPTE0007875_Thy1_8
  gRNA
uuuggggagacacagacccg

SEQ ID NO: 137097 - RNA, 20 nt, Artificial Sequence
  mmSKRIPTE0007876_Thy1_9
  gRNA
ccuagccaacuucaccacca

SEQ ID NO: 137098 - RNA, 20 nt, Artificial Sequence
  mmSKRIPTE0007877_Fasl_1
  gRNA
cuacucuagauacaauugug

SEQ ID NO: 137099 - RNA, 20 nt, Artificial Sequence
  mmSKRIPTE0007878_Fasl_2
  gRNA
uauuccaaaguauacuuccg

SEQ ID NO: 137100 - RNA, 20 nt, Artificial Sequence
  mmSKRIPTE0007879_Fasl_3
  gRNA
ccucugaaaaaaaagagccg

SEQ ID NO: 137101 - RNA, 20 nt, Artificial Sequence
  mmSKRIPTE0007880_Fasl_4
  gRNA
aacgugcugaagaaacucag

SEQ ID NO: 137102 - RNA, 20 nt, Artificial Sequence
  mmSKRIPTE0007881_Fasl_5
  gRNA
ugucgucagaaauuucuggg

SEQ ID NO: 137103 - RNA, 20 nt, Artificial Sequence
  mmSKRIPTE0007882_Fasl_6
  gRNA
uaagauugaauacugccccc

SEQ ID NO: 137104 - RNA, 20 nt, Artificial Sequence
  mmSKRIPTE0007883_Fasl_7
  gRNA
agcaacacaguagcccacau

SEQ ID NO: 137105 - RNA, 20 nt, Artificial Sequence
  mmSKRIPTE0007884_Fasl_8
  gRNA
gaggaacucuaaguauccug

SEQ ID NO: 137106 - RNA, 20 nt, Artificial Sequence
  mmSKRIPTE0007885_Fasl_9
  gRNA
cuucacuccagagaucagag

SEQ ID NO: 137107 - RNA, 20 nt, Artificial Sequence
  mmSKRIPTE0007886_C1qbp_1
  gRNA
ugugggcugaccuucccgug

SEQ ID NO: 137108 - RNA, 20 nt, Artificial Sequence
  mmSKRIPTE0007887_C1qbp_2
  gRNA
uggucaagguagcugaguca

SEQ ID NO: 137109 - RNA, 20 nt, Artificial Sequence
  mmSKRIPTE0007888_C1qbp_3
  gRNA
ggaagcgcuuuccaccccag

SEQ ID NO: 137110 - RNA, 20 nt, Artificial Sequence
  mmSKRIPTE0007889_C1qbp_4
  gRNA
ggggaagcuuucgaucacga

SEQ ID NO: 137111 - RNA, 20 nt, Artificial Sequence
  mmSKRIPTE0007890_C1qbp_5
  gRNA
uauaaugcuaucacccuggg

SEQ ID NO: 137112 - RNA, 20 nt, Artificial Sequence
  mmSKRIPTE0007891_C1qbp_6
  gRNA
cguacgcugagcaaaccgaa

SEQ ID NO: 137113 - RNA, 20 nt, Artificial Sequence
  mmSKRIPTE0007892_C1qbp_7
  gRNA
gugugcugaaccacacggga

SEQ ID NO: 137114 - RNA, 20 nt, Artificial Sequence
  mmSKRIPTE0007893_C1qbp_8
  gRNA
cacgcacccuagucggagug

SEQ ID NO: 137115 - RNA, 20 nt, Artificial Sequence
  mmSKRIPTE0007894_C1qbp_9
  gRNA
ugucauccuaauauaucggg

SEQ ID NO: 137116 - RNA, 20 nt, Artificial Sequence
  mmSKRIPTE0007895_Sftpd_1
  gRNA
ggauguagcccucuucaucg

SEQ ID NO: 137117 - RNA, 20 nt, Artificial Sequence
  mmSKRIPTE0007896_Sftpd_2
  gRNA
uggguacugaucucugcgag

SEQ ID NO: 137118 - RNA, 20 nt, Artificial Sequence
  mmSKRIPTE0007897_Sftpd_3
  gRNA
ucuaucgaagucauauggga

SEQ ID NO: 137119 - RNA, 20 nt, Artificial Sequence
  mmSKRIPTE0007898_Sftpd_4
  gRNA
acuaaacugaucgauccccc

SEQ ID NO: 137120 - RNA, 20 nt, Artificial Sequence
  mmSKRIPTE0007899_Sftpd_5
  gRNA
gcccaauuagaauagaccag

SEQ ID NO: 137121 - RNA, 20 nt, Artificial Sequence
  mmSKRIPTE0007900_Sftpd_6
  gRNA
uggguggucaauagaacuug

SEQ ID NO: 137122 - RNA, 20 nt, Artificial Sequence
  mmSKRIPTE0007901_Sftpd_7
  gRNA
gcauuuaccuggaccuccug

SEQ ID NO: 137123 - RNA, 20 nt, Artificial Sequence
  mmSKRIPTE0007902_Sftpd_8
  gRNA
aggaaaacuacagcgucuag

SEQ ID NO: 137124 - RNA, 20 nt, Artificial Sequence
  mmSKRIPTE0007903_Sftpd_9
  gRNA
cucaguagcagaacgugggg

SEQ ID NO: 137125 - RNA, 20 nt, Artificial Sequence
  mmSKRIPTE0007904_Lcp1_1
  gRNA
agggauaugagacaccggag

SEQ ID NO: 137126 - RNA, 20 nt, Artificial Sequence
  mmSKRIPTE0007905_Lcp1_2
  gRNA
cuucuuaagagacaucuccg

SEQ ID NO: 137127 - RNA, 20 nt, Artificial Sequence
  mmSKRIPTE0007906_Lcp1_3
  gRNA
ucgcacauggauccuugacc

SEQ ID NO: 137128 - RNA, 20 nt, Artificial Sequence
  mmSKRIPTE0007907_Lcp1_4
  gRNA
aggaaaccgaacucucacgc

SEQ ID NO: 137129 - RNA, 20 nt, Artificial Sequence
  mmSKRIPTE0007908_Lcp1_5
  gRNA
uucagcaccgacaucaaggu

SEQ ID NO: 137130 - RNA, 20 nt, Artificial Sequence
  mmSKRIPTE0007909_Lcp1_6
  gRNA
ucugugugugacgaaaggua

SEQ ID NO: 137131 - RNA, 20 nt, Artificial Sequence
  mmSKRIPTE0007910_Lcp1_7
  gRNA
uaguauaaaucacaguagug

SEQ ID NO: 137132 - RNA, 20 nt, Artificial Sequence
  mmSKRIPTE0007911_Lcp1_8
  gRNA
ucacucaccuaggugagacg

SEQ ID NO: 137133 - RNA, 20 nt, Artificial Sequence
  mmSKRIPTE0007912_Lcp1_9
  gRNA
auaaaggauaucuacgggcg

SEQ ID NO: 137134 - RNA, 20 nt, Artificial Sequence
  mmSKRIPTE0007913_H2-Q1_1
  gRNA
cccuguguagggacgucgag

SEQ ID NO: 137135 - RNA, 20 nt, Artificial Sequence
  mmSKRIPTE0007914_H2-Q1_2
  gRNA
auaaaguccacgcagcucga

SEQ ID NO: 137136 - RNA, 20 nt, Artificial Sequence
  mmSKRIPTE0007915_H2-Q1_3
  gRNA
gacccugaccaaaaccggag

SEQ ID NO: 137137 - RNA, 20 nt, Artificial Sequence
  mmSKRIPTE0007916_H2-Q1_4
  gRNA
aguucuguggagucgcgcgu

SEQ ID NO: 137138 - RNA, 20 nt, Artificial Sequence
  mmSKRIPTE0007917_H2-Q1_5
  gRNA
gggaccgccauacaucacuc

SEQ ID NO: 137139 - RNA, 20 nt, Artificial Sequence
  mmSKRIPTE0007918_H2-Q1_6
  gRNA
gcgcccacagaguagcuggu

SEQ ID NO: 137140 - RNA, 20 nt, Artificial Sequence
  mmSKRIPTE0007919_H2-Q1_7
  gRNA
agaucuuagccuagguuacg

SEQ ID NO: 137141 - RNA, 20 nt, Artificial Sequence
  mmSKRIPTE0007920_H2-Q1_8
  gRNA
gcugcgguauuucgagaccu

SEQ ID NO: 137142 - RNA, 20 nt, Artificial Sequence
  mmSKRIPTE0007921_H2-Q1_9
  gRNA
ucagaugggcgccuucaaag

SEQ ID NO: 137143 - RNA, 20 nt, Artificial Sequence
  mmSKRIPTE0007922_H2-T23_1
  gRNA
aagcagaucaggcucgacaa

SEQ ID NO: 137144 - RNA, 20 nt, Artificial Sequence
  mmSKRIPTE0007923_H2-T23_2
  gRNA
cauucgcgguccaggaacgc

SEQ ID NO: 137145 - RNA, 20 nt, Artificial Sequence
  mmSKRIPTE0007924_H2-T23_3
  gRNA
gcuguucagcgggcacagcg

SEQ ID NO: 137146 - RNA, 20 nt, Artificial Sequence
  mmSKRIPTE0007925_H2-T23_4
  gRNA
ggauuucccccaaaccgcag

SEQ ID NO: 137147 - RNA, 20 nt, Artificial Sequence
  mmSKRIPTE0007926_H2-T23_5
  gRNA
cuccauagauaccuacggcu

SEQ ID NO: 137148 - RNA, 20 nt, Artificial Sequence
  mmSKRIPTE0007927_H2-T23_6
  gRNA
uaacgacggugagugcggcu

SEQ ID NO: 137149 - RNA, 20 nt, Artificial Sequence
  mmSKRIPTE0007928_H2-T23_7
  gRNA
ggacagggcggcggaacuug

SEQ ID NO: 137150 - RNA, 20 nt, Artificial Sequence
  mmSKRIPTE0007929_H2-T23_8
  gRNA
gaaugaaugaaaaucccugg

SEQ ID NO: 137151 - RNA, 20 nt, Artificial Sequence
  mmSKRIPTE0007930_H2-T23_9
  gRNA
aggcaugaaaaucccugggg

SEQ ID NO: 137152 - RNA, 20 nt, Artificial Sequence
  mmSKRIPTE0007931_Clcf1_1
  gRNA
uggaaaaccucccaugucag

SEQ ID NO: 137153 - RNA, 20 nt, Artificial Sequence
  mmSKRIPTE0007932_Clcf1_2
  gRNA
gccaaaggggauacucacgu

SEQ ID NO: 137154 - RNA, 20 nt, Artificial Sequence
  mmSKRIPTE0007933_Clcf1_3
  gRNA
ccugggagagaugauugccg

SEQ ID NO: 137155 - RNA, 20 nt, Artificial Sequence
  mmSKRIPTE0007934_Clcf1_4
  gRNA
uccagccccaggauacaccg

SEQ ID NO: 137156 - RNA, 20 nt, Artificial Sequence
  mmSKRIPTE0007935_Clcf1_5
  gRNA
aaaucguacagugggcaucg

SEQ ID NO: 137157 - RNA, 20 nt, Artificial Sequence
  mmSKRIPTE0007936_Clcf1_6
  gRNA
uuaaagcuucgccggagccg

SEQ ID NO: 137158 - RNA, 20 nt, Artificial Sequence
  mmSKRIPTE0007937_Clcf1_7
  gRNA
agcuacgcggacuuugcuug

SEQ ID NO: 137159 - RNA, 20 nt, Artificial Sequence
  mmSKRIPTE0007938_Clcf1_8
  gRNA
gggagggguccgagaucgag

SEQ ID NO: 137160 - RNA, 20 nt, Artificial Sequence
  mmSKRIPTE0007939_Clcf1_9
  gRNA
uacauugcaguagcauugug

SEQ ID NO: 137161 - RNA, 20 nt, Artificial Sequence
  mmSKRIPTE0007940_Dab2ip_1
  gRNA
acaccuccuuaagcucccgu

SEQ ID NO: 137162 - RNA, 20 nt, Artificial Sequence
  mmSKRIPTE0007941_Dab2ip_2
  gRNA
cauccacuuaucgcgcucag

SEQ ID NO: 137163 - RNA, 20 nt, Artificial Sequence
  mmSKRIPTE0007942_Dab2ip_3
  gRNA
uggacaucccucaggauacg

SEQ ID NO: 137164 - RNA, 20 nt, Artificial Sequence
  mmSKRIPTE0007943_Dab2ip_4
  gRNA
cugggaugggcauaggaccg

SEQ ID NO: 137165 - RNA, 20 nt, Artificial Sequence
  mmSKRIPTE0007944_Dab2ip_5
  gRNA
cuugcaacagacaaguccgg

SEQ ID NO: 137166 - RNA, 20 nt, Artificial Sequence
  mmSKRIPTE0007945_Dab2ip_6
  gRNA
accuacuagugccuagaugu

SEQ ID NO: 137167 - RNA, 20 nt, Artificial Sequence
  mmSKRIPTE0007946_Dab2ip_7
  gRNA
uaaucccccugggcccaaag

SEQ ID NO: 137168 - RNA, 20 nt, Artificial Sequence
  mmSKRIPTE0007947_Dab2ip_8
  gRNA
gcaggacgcacuagguagug

SEQ ID NO: 137169 - RNA, 20 nt, Artificial Sequence
  mmSKRIPTE0007948_Dab2ip_9
  gRNA
caagugaggugaaaugaccg

SEQ ID NO: 137170 - RNA, 20 nt, Artificial Sequence
  mmSKRIPTE0007949_Sla2_1
  gRNA
cgucagaggaaauagaggcg

SEQ ID NO: 137171 - RNA, 20 nt, Artificial Sequence
  mmSKRIPTE0007950_Sla2_2
  gRNA
auguggcuaaagucgcccac

SEQ ID NO: 137172 - RNA, 20 nt, Artificial Sequence
  mmSKRIPTE0007951_Sla2_3
  gRNA
aucucgucaagguuacucag

SEQ ID NO: 137173 - RNA, 20 nt, Artificial Sequence
  mmSKRIPTE0007952_Sla2_4
  gRNA
gaagacccacugagguaccg

SEQ ID NO: 137174 - RNA, 20 nt, Artificial Sequence
  mmSKRIPTE0007953_Sla2_5
  gRNA
guagucgcacuccaggagga

SEQ ID NO: 137175 - RNA, 20 nt, Artificial Sequence
  mmSKRIPTE0007954_Sla2_6
  gRNA
gcccucguacagccaccugg

SEQ ID NO: 137176 - RNA, 20 nt, Artificial Sequence
  mmSKRIPTE0007955_Sla2_7
  gRNA
ccacucacaucuuagcacaa

SEQ ID NO: 137177 - RNA, 20 nt, Artificial Sequence
  mmSKRIPTE0007956_Sla2_8
  gRNA
guuuaccuagcccaaucaag

SEQ ID NO: 137178 - RNA, 20 nt, Artificial Sequence
  mmSKRIPTE0007957_Sla2_9
  gRNA
cagacuaucucugagacucg

SEQ ID NO: 137179 - RNA, 20 nt, Artificial Sequence
  mmSKRIPTE0007958_Zc3h12a_1
  gRNA
acaccccguuccacgcacca

SEQ ID NO: 137180 - RNA, 20 nt, Artificial Sequence
  mmSKRIPTE0007959_Zc3h12a_2
  gRNA
agacgacguccggcgcucag

SEQ ID NO: 137181 - RNA, 20 nt, Artificial Sequence
  mmSKRIPTE0007960_Zc3h12a_3
  gRNA
uucacgccauccaggcgggu

SEQ ID NO: 137182 - RNA, 20 nt, Artificial Sequence
  mmSKRIPTE0007961_Zc3h12a_4
  gRNA
gguguauauaccaagcugug

SEQ ID NO: 137183 - RNA, 20 nt, Artificial Sequence
  mmSKRIPTE0007962_Zc3h12a_5
  gRNA
ggacaggcuucguuccacaa

SEQ ID NO: 137184 - RNA, 20 nt, Artificial Sequence
  mmSKRIPTE0007963_Zc3h12a_6
  gRNA
uaggauugguucuggccccg

SEQ ID NO: 137185 - RNA, 20 nt, Artificial Sequence
  mmSKRIPTE0007964_Zc3h12a_7
  gRNA
ugacaaguacguuacugcug

SEQ ID NO: 137186 - RNA, 20 nt, Artificial Sequence
  mmSKRIPTE0007965_Zc3h12a_8
  gRNA
ccguccuaaagggucgucag

SEQ ID NO: 137187 - RNA, 20 nt, Artificial Sequence
  mmSKRIPTE0007966_Zc3h12a_9
  gRNA
guuugggcaucagccacgga

SEQ ID NO: 137188 - RNA, 20 nt, Artificial Sequence
  mmSKRIPTE0007967_Cxcl3_1
  gRNA
uaaggcucgagguucugcug

SEQ ID NO: 137189 - RNA, 20 nt, Artificial Sequence
  mmSKRIPTE0007968_Cxcl3_2
  gRNA
agaaaacuugagaaacgccg

SEQ ID NO: 137190 - RNA, 20 nt, Artificial Sequence
  mmSKRIPTE0007969_Cxcl3_3
  gRNA
cacacucaucaagagcccgg

SEQ ID NO: 137191 - RNA, 20 nt, Artificial Sequence
  mmSKRIPTE0007970_Cxcl3_4
  gRNA
cuuaagcaacaggcccucca

SEQ ID NO: 137192 - RNA, 20 nt, Artificial Sequence
  mmSKRIPTE0007971_Cxcl3_5
  gRNA
auguauaaaagggguucgca

SEQ ID NO: 137193 - RNA, 20 nt, Artificial Sequence
  mmSKRIPTE0007972_Cxcl3_6
  gRNA
caucuuacuucucacgacag

SEQ ID NO: 137194 - RNA, 20 nt, Artificial Sequence
  mmSKRIPTE0007973_Cxcl3_7
  gRNA
agugccugaacacccuacca

SEQ ID NO: 137195 - RNA, 20 nt, Artificial Sequence
  mmSKRIPTE0007974_Cxcl3_8
  gRNA
ccucuuucuaucgcauaaga

SEQ ID NO: 137196 - RNA, 20 nt, Artificial Sequence
  mmSKRIPTE0007975_Cxcl3_9
  gRNA
uucauaaguuaagugagacc

SEQ ID NO: 137197 - RNA, 20 nt, Artificial Sequence
  mmSKRIPTE0007976_Spib_1
  gRNA
uggaaccguagacgacauca

SEQ ID NO: 137198 - RNA, 20 nt, Artificial Sequence
  mmSKRIPTE0007977_Spib_2
  gRNA
gggguacggagcauaagcca

SEQ ID NO: 137199 - RNA, 20 nt, Artificial Sequence
  mmSKRIPTE0007978_Spib_3
  gRNA
agccaguagauggcaugggu

SEQ ID NO: 137200 - RNA, 20 nt, Artificial Sequence
  mmSKRIPTE0007979_Spib_4
  gRNA
uuugugcacaacggaaaccc

SEQ ID NO: 137201 - RNA, 20 nt, Artificial Sequence
  mmSKRIPTE0007980_Spib_5
  gRNA
ugaaaacuaaggguggcgag

SEQ ID NO: 137202 - RNA, 20 nt, Artificial Sequence
  mmSKRIPTE0007981_Spib_6
  gRNA
cuagauuggaauccuauaca

SEQ ID NO: 137203 - RNA, 20 nt, Artificial Sequence
  mmSKRIPTE0007982_Spib_7
  gRNA
ucugugcuuacccacgccau

SEQ ID NO: 137204 - RNA, 20 nt, Artificial Sequence
  mmSKRIPTE0007983_Spib_8
  gRNA
gagugcucagacaugccggg

SEQ ID NO: 137205 - RNA, 20 nt, Artificial Sequence
  mmSKRIPTE0007984_Spib_9
  gRNA
ccugucccgauaggguugug

SEQ ID NO: 137206 - RNA, 20 nt, Artificial Sequence
  mmSKRIPTE0007985_Scg2_1
  gRNA
cugguauggaucaagcagca

SEQ ID NO: 137207 - RNA, 20 nt, Artificial Sequence
  mmSKRIPTE0007986_Scg2_2
  gRNA
auacgagcuugaaggcacga

SEQ ID NO: 137208 - RNA, 20 nt, Artificial Sequence
  mmSKRIPTE0007987_Scg2_3
  gRNA
guggaugcggauaauacucg

SEQ ID NO: 137209 - RNA, 20 nt, Artificial Sequence
  mmSKRIPTE0007988_Scg2_4
  gRNA
gugagcaaaaggauccccgu

SEQ ID NO: 137210 - RNA, 20 nt, Artificial Sequence
  mmSKRIPTE0007989_Scg2_5
  gRNA
acgcacaaaugaaauagucg

SEQ ID NO: 137211 - RNA, 20 nt, Artificial Sequence
  mmSKRIPTE0007990_Scg2_6
  gRNA
gcccucacucagcggcagag

SEQ ID NO: 137212 - RNA, 20 nt, Artificial Sequence
  mmSKRIPTE0007991_Scg2_7
  gRNA
auucacuaaccuucucaggu

SEQ ID NO: 137213 - RNA, 20 nt, Artificial Sequence
  mmSKRIPTE0007992_Scg2_8
  gRNA
uacgugugugccgaaaugag

SEQ ID NO: 137214 - RNA, 20 nt, Artificial Sequence
  mmSKRIPTE0007993_Scg2_9
  gRNA
gcccaguccagucuccucag

SEQ ID NO: 137215 - RNA, 20 nt, Artificial Sequence
  mmSKRIPTE0007994_Tcf3_1
  gRNA
uuaccacuauaggagucggg

SEQ ID NO: 137216 - RNA, 20 nt, Artificial Sequence
  mmSKRIPTE0007995_Tcf3_2
  gRNA
auuauugcuggagugauccg

SEQ ID NO: 137217 - RNA, 20 nt, Artificial Sequence
  mmSKRIPTE0007996_Tcf3_3
  gRNA
uaggccguuagcagccugug

SEQ ID NO: 137218 - RNA, 20 nt, Artificial Sequence
  mmSKRIPTE0007997_Tcf3_4
  gRNA
ggaguccuuguucacccggg

SEQ ID NO: 137219 - RNA, 20 nt, Artificial Sequence
  mmSKRIPTE0007998_Tcf3_5
  gRNA
ccuaggugagccuacaccug

SEQ ID NO: 137220 - RNA, 20 nt, Artificial Sequence
  mmSKRIPTE0007999_Tcf3_6
  gRNA
uggugggacagaauagugcc

SEQ ID NO: 137221 - RNA, 20 nt, Artificial Sequence
  mmSKRIPTE0008000_Tcf3_7
  gRNA
guucaaaauccaaucaccgg

SEQ ID NO: 137222 - RNA, 20 nt, Artificial Sequence
  mmSKRIPTE0008001_Tcf3_8
  gRNA
cugucccacucaccgaggaa

SEQ ID NO: 137223 - RNA, 20 nt, Artificial Sequence
  mmSKRIPTE0008002_Tcf3_9
  gRNA
ucacacaggacauuucgcug

SEQ ID NO: 137224 - RNA, 20 nt, Artificial Sequence
  mmSKRIPTE0008003_Grap_1
  gRNA
cuuacggauaccuccagaca

SEQ ID NO: 137225 - RNA, 20 nt, Artificial Sequence
  mmSKRIPTE0008004_Grap_2
  gRNA
uggagcgugaggauccacac

SEQ ID NO: 137226 - RNA, 20 nt, Artificial Sequence
  mmSKRIPTE0008005_Grap_3
  gRNA
gcacuucaaagugcuucgag

SEQ ID NO: 137227 - RNA, 20 nt, Artificial Sequence
  mmSKRIPTE0008006_Grap_4
  gRNA
ccuccgccgaggugacaucg

SEQ ID NO: 137228 - RNA, 20 nt, Artificial Sequence
  mmSKRIPTE0008007_Grap_5
  gRNA
agagacggagaacucgccag

SEQ ID NO: 137229 - RNA, 20 nt, Artificial Sequence
  mmSKRIPTE0008008_Grap_6
  gRNA
cucucgucaaaaaugcucag

SEQ ID NO: 137230 - RNA, 20 nt, Artificial Sequence
  mmSKRIPTE0008009_Grap_7
  gRNA
uggcaguggugacuacucac

SEQ ID NO: 137231 - RNA, 20 nt, Artificial Sequence
  mmSKRIPTE0008010_Grap_8
  gRNA
uccuggccuaaugcacagua

SEQ ID NO: 137232 - RNA, 20 nt, Artificial Sequence
  mmSKRIPTE0008011_Grap_9
  gRNA
guaggggaggaugcccaaug

SEQ ID NO: 137233 - RNA, 20 nt, Artificial Sequence
  mmSKRIPTE0008012_Foxn1_1
  gRNA
uuguccccaagcucacacga

SEQ ID NO: 137234 - RNA, 20 nt, Artificial Sequence
  mmSKRIPTE0008013_Foxn1_2
  gRNA
cugaaggucccaaaaaacga

SEQ ID NO: 137235 - RNA, 20 nt, Artificial Sequence
  mmSKRIPTE0008014_Foxn1_3
  gRNA
ccuugggccugguagaugug

SEQ ID NO: 137236 - RNA, 20 nt, Artificial Sequence
  mmSKRIPTE0008015_Foxn1_4
  gRNA
cuccccgacuaggaaaucug

SEQ ID NO: 137237 - RNA, 20 nt, Artificial Sequence
  mmSKRIPTE0008016_Foxn1_5
  gRNA
uggcaguagaguaucgugca

SEQ ID NO: 137238 - RNA, 20 nt, Artificial Sequence
  mmSKRIPTE0008017_Foxn1_6
  gRNA
ccccugcaggaccuacuggg

SEQ ID NO: 137239 - RNA, 20 nt, Artificial Sequence
  mmSKRIPTE0008018_Foxn1_7
  gRNA
cucagccucacagaacgugu

SEQ ID NO: 137240 - RNA, 20 nt, Artificial Sequence
  mmSKRIPTE0008019_Foxn1_8
  gRNA
gguuggccaugccuagacgu

SEQ ID NO: 137241 - RNA, 20 nt, Artificial Sequence
  mmSKRIPTE0008020_Foxn1_9
  gRNA
ggaggaugacgucggcgacg

SEQ ID NO: 137242 - RNA, 20 nt, Artificial Sequence
  mmSKRIPTE0008021_Adk_1
  gRNA
uaugggagucacacugucga

SEQ ID NO: 137243 - RNA, 20 nt, Artificial Sequence
  mmSKRIPTE0008022_Adk_2
  gRNA
ugaugacgcuugcugcguag

SEQ ID NO: 137244 - RNA, 20 nt, Artificial Sequence
  mmSKRIPTE0008023_Adk_3
  gRNA
uuuccauggcaacugcagcg

SEQ ID NO: 137245 - RNA, 20 nt, Artificial Sequence
  mmSKRIPTE0008024_Adk_4
  gRNA
aggaccgugaucuucacaca

SEQ ID NO: 137246 - RNA, 20 nt, Artificial Sequence
  mmSKRIPTE0008025_Adk_5
  gRNA
cacgcagcacaaguuccugu

SEQ ID NO: 137247 - RNA, 20 nt, Artificial Sequence
  mmSKRIPTE0008026_Adk_6
  gRNA
gcauaagcauguuguaacug

SEQ ID NO: 137248 - RNA, 20 nt, Artificial Sequence
  mmSKRIPTE0008027_Adk_7
  gRNA
uaguggcugcagguacugug

SEQ ID NO: 137249 - RNA, 20 nt, Artificial Sequence
  mmSKRIPTE0008028_Adk_8
  gRNA
gaagugaagugauuaaacug

SEQ ID NO: 137250 - RNA, 20 nt, Artificial Sequence
  mmSKRIPTE0008029_Adk_9
  gRNA
cggcagcaagguuagcaacg

SEQ ID NO: 137251 - RNA, 20 nt, Artificial Sequence
  mmSKRIPTE0008030_Arl11_1
  gRNA
cugcccuaaccacucgagag

SEQ ID NO: 137252 - RNA, 20 nt, Artificial Sequence
  mmSKRIPTE0008031_Arl11_2
  gRNA
gggcggggcuccacuaacaa

SEQ ID NO: 137253 - RNA, 20 nt, Artificial Sequence
  mmSKRIPTE0008032_Arl11_3
  gRNA
auuguggagaggugcccuag

SEQ ID NO: 137254 - RNA, 20 nt, Artificial Sequence
  mmSKRIPTE0008033_Arl11_4
  gRNA
ccagcucagagcuaccugga

SEQ ID NO: 137255 - RNA, 20 nt, Artificial Sequence
  mmSKRIPTE0008034_Arl11_5
  gRNA
cagagguuacugcauuucag

SEQ ID NO: 137256 - RNA, 20 nt, Artificial Sequence
  mmSKRIPTE0008035_Arl11_6
  gRNA
acauacuccuaagagugcua

SEQ ID NO: 137257 - RNA, 20 nt, Artificial Sequence
  mmSKRIPTE0008036_Arl11_7
  gRNA
agcuguucugcccgcucacg

SEQ ID NO: 137258 - RNA, 20 nt, Artificial Sequence
  mmSKRIPTE0008037_Arl11_8
  gRNA
uaacuacuuaggaaggacgc

SEQ ID NO: 137259 - RNA, 20 nt, Artificial Sequence
  mmSKRIPTE0008038_Arl11_9
  gRNA
uuguagugggcuguuacccg

SEQ ID NO: 137260 - RNA, 20 nt, Artificial Sequence
  mmSKRIPTE0008039_Gfer_1
  gRNA
acgcuccuccgaacugucgc

SEQ ID NO: 137261 - RNA, 20 nt, Artificial Sequence
  mmSKRIPTE0008040_Gfer_2
  gRNA
gauuaccagcaguucgugag

SEQ ID NO: 137262 - RNA, 20 nt, Artificial Sequence
  mmSKRIPTE0008041_Gfer_3
  gRNA
gaccuggugacugacgcgcg

SEQ ID NO: 137263 - RNA, 20 nt, Artificial Sequence
  mmSKRIPTE0008042_Gfer_4
  gRNA
cuccaaaccuugcggcgccg

SEQ ID NO: 137264 - RNA, 20 nt, Artificial Sequence
  mmSKRIPTE0008043_Gfer_5
  gRNA
aaggagaagcgacugccgcg

SEQ ID NO: 137265 - RNA, 20 nt, Artificial Sequence
  mmSKRIPTE0008044_Gfer_6
  gRNA
ugucccaaaugaaggguacg

SEQ ID NO: 137266 - RNA, 20 nt, Artificial Sequence
  mmSKRIPTE0008045_Gfer_7
  gRNA
aacucgaucugacuagccag

SEQ ID NO: 137267 - RNA, 20 nt, Artificial Sequence
  mmSKRIPTE0008046_Gfer_8
  gRNA
uagucggccuacuucugcag

SEQ ID NO: 137268 - RNA, 20 nt, Artificial Sequence
  mmSKRIPTE0008047_Gfer_9
  gRNA
auaaugggaauucgaaccga

SEQ ID NO: 137269 - RNA, 20 nt, Artificial Sequence
  mmSKRIPTE0008048_Ppm1b_1
  gRNA
ucguuccagucuaagcacgc

SEQ ID NO: 137270 - RNA, 20 nt, Artificial Sequence
  mmSKRIPTE0008049_Ppm1b_2
  gRNA
uuaguguugaaaucaucgug

SEQ ID NO: 137271 - RNA, 20 nt, Artificial Sequence
  mmSKRIPTE0008050_Ppm1b_3
  gRNA
cagcaguacccgacuuacug

SEQ ID NO: 137272 - RNA, 20 nt, Artificial Sequence
  mmSKRIPTE0008051_Ppm1b_4
  gRNA
gaccaguuguccaagccgug

SEQ ID NO: 137273 - RNA, 20 nt, Artificial Sequence
  mmSKRIPTE0008052_Ppm1b_5
  gRNA
uuacaaagcugacuaugcaa

SEQ ID NO: 137274 - RNA, 20 nt, Artificial Sequence
  mmSKRIPTE0008053_Ppm1b_6
  gRNA
uaguuugucuacugacacug

SEQ ID NO: 137275 - RNA, 20 nt, Artificial Sequence
  mmSKRIPTE0008054_Ppm1b_7
  gRNA
caaaugagaguuaaccauag

SEQ ID NO: 137276 - RNA, 20 nt, Artificial Sequence
  mmSKRIPTE0008055_Ppm1b_8
  gRNA
agaguacaaaugcgcaggcg

SEQ ID NO: 137277 - RNA, 20 nt, Artificial Sequence
  mmSKRIPTE0008056_Ppm1b_9
  gRNA
acagccguaaugaagaugca

SEQ ID NO: 137278 - RNA, 20 nt, Artificial Sequence
  mmSKRIPTE0008057_Socs6_1
  gRNA
gcccaguugaauaaacgugu

SEQ ID NO: 137279 - RNA, 20 nt, Artificial Sequence
  mmSKRIPTE0008058_Socs6_2
  gRNA
guuaugcccaaacaucggga

SEQ ID NO: 137280 - RNA, 20 nt, Artificial Sequence
  mmSKRIPTE0008059_Socs6_3
  gRNA
uguacugacggauaacaaag

SEQ ID NO: 137281 - RNA, 20 nt, Artificial Sequence
  mmSKRIPTE0008060_Socs6_4
  gRNA
ggaacagugacacuucuggg

SEQ ID NO: 137282 - RNA, 20 nt, Artificial Sequence
  mmSKRIPTE0008061_Socs6_5
  gRNA
accugcaugaaucgugacac

SEQ ID NO: 137283 - RNA, 20 nt, Artificial Sequence
  mmSKRIPTE0008062_Socs6_6
  gRNA
ccacugggugcugcaucuaa

SEQ ID NO: 137284 - RNA, 20 nt, Artificial Sequence
  mmSKRIPTE0008063_Socs6_7
  gRNA
gagaaggcaccacucgcccc

SEQ ID NO: 137285 - RNA, 20 nt, Artificial Sequence
  mmSKRIPTE0008064_Socs6_8
  gRNA
ucagcacagcccgguaggcg

SEQ ID NO: 137286 - RNA, 20 nt, Artificial Sequence
  mmSKRIPTE0008065_Socs6_9
  gRNA
gucaucaauuuguucaaggg

SEQ ID NO: 137287 - RNA, 20 nt, Artificial Sequence
  mmSKRIPTE0008066_Men1_1
  gRNA
ccagacagucaaugccggug

SEQ ID NO: 137288 - RNA, 20 nt, Artificial Sequence
  mmSKRIPTE0008067_Men1_2
  gRNA
ccaaguucccuagcgccaug

SEQ ID NO: 137289 - RNA, 20 nt, Artificial Sequence
  mmSKRIPTE0008068_Men1_3
  gRNA
acgucgucgauagagcgcag

SEQ ID NO: 137290 - RNA, 20 nt, Artificial Sequence
  mmSKRIPTE0008069_Men1_4
  gRNA
agugcggaaaucuaccccua

SEQ ID NO: 137291 - RNA, 20 nt, Artificial Sequence
  mmSKRIPTE0008070_Men1_5
  gRNA
cccacaccaguacugcacgu

SEQ ID NO: 137292 - RNA, 20 nt, Artificial Sequence
  mmSKRIPTE0008071_Men1_6
  gRNA
ggugguguuugggcccaacg

SEQ ID NO: 137293 - RNA, 20 nt, Artificial Sequence
  mmSKRIPTE0008072_Men1_7
  gRNA
aacaggcgaagagcggacug

SEQ ID NO: 137294 - RNA, 20 nt, Artificial Sequence
  mmSKRIPTE0008073_Men1_8
  gRNA
auuggcgcacccuccguccg

SEQ ID NO: 137295 - RNA, 20 nt, Artificial Sequence
  mmSKRIPTE0008074_Men1_9
  gRNA
ugauggauaggucggccacc

SEQ ID NO: 137296 - RNA, 20 nt, Artificial Sequence
  mmSKRIPTE0008075_Bank1_1
  gRNA
ccagcacugcucauucggug

SEQ ID NO: 137297 - RNA, 20 nt, Artificial Sequence
  mmSKRIPTE0008076_Bank1_2
  gRNA
acucuggggauuguggcccg

SEQ ID NO: 137298 - RNA, 20 nt, Artificial Sequence
  mmSKRIPTE0008077_Bank1_3
  gRNA
gccacguucacuagagccaa

SEQ ID NO: 137299 - RNA, 20 nt, Artificial Sequence
  mmSKRIPTE0008078_Bank1_4
  gRNA
ucaacagagcaggauccgga

SEQ ID NO: 137300 - RNA, 20 nt, Artificial Sequence
  mmSKRIPTE0008079_Bank1_5
  gRNA
uacuacauguccucuauacg

SEQ ID NO: 137301 - RNA, 20 nt, Artificial Sequence
  mmSKRIPTE0008080_Bank1_6
  gRNA
accauugugcaccauccaag

SEQ ID NO: 137302 - RNA, 20 nt, Artificial Sequence
  mmSKRIPTE0008081_Bank1_7
  gRNA
agguccugaagacuaccuug

SEQ ID NO: 137303 - RNA, 20 nt, Artificial Sequence
  mmSKRIPTE0008082_Bank1_8
  gRNA
aaggccuaacccuagccuug

SEQ ID NO: 137304 - RNA, 20 nt, Artificial Sequence
  mmSKRIPTE0008083_Bank1_9
  gRNA
auacuccggacaagugucgg

SEQ ID NO: 137305 - RNA, 20 nt, Artificial Sequence
  mmSKRIPTE0008084_Rac1_1
  gRNA
uggacucaacgccccaucug

SEQ ID NO: 137306 - RNA, 20 nt, Artificial Sequence
  mmSKRIPTE0008085_Rac1_2
  gRNA
ccacgggcucauaaacccau

SEQ ID NO: 137307 - RNA, 20 nt, Artificial Sequence
  mmSKRIPTE0008086_Rac1_3
  gRNA
uguguagguucguguuaacg

SEQ ID NO: 137308 - RNA, 20 nt, Artificial Sequence
  mmSKRIPTE0008087_Rac1_4
  gRNA
aggaggauacucacacggug

SEQ ID NO: 137309 - RNA, 20 nt, Artificial Sequence
  mmSKRIPTE0008088_Rac1_5
  gRNA
gccguuguuaagccgucgug

SEQ ID NO: 137310 - RNA, 20 nt, Artificial Sequence
  mmSKRIPTE0008089_Rac1_6
  gRNA
ugguccagaaaacaccgcug

SEQ ID NO: 137311 - RNA, 20 nt, Artificial Sequence
  mmSKRIPTE0008090_Rac1_7
  gRNA
aguaacuuccaaucccguaa

SEQ ID NO: 137312 - RNA, 20 nt, Artificial Sequence
  mmSKRIPTE0008091_Rac1_8
  gRNA
cuucgcuagcuaucggcgug

SEQ ID NO: 137313 - RNA, 20 nt, Artificial Sequence
  mmSKRIPTE0008092_Rac1_9
  gRNA
agggcugagacaaacgugug

SEQ ID NO: 137314 - RNA, 20 nt, Artificial Sequence
  mmSKRIPTE0008093_Apobec1_1
  gRNA
aaauuccuccagguacacca

SEQ ID NO: 137315 - RNA, 20 nt, Artificial Sequence
  mmSKRIPTE0008094_Apobec1_2
  gRNA
ugcugcgugucaucacacaa

SEQ ID NO: 137316 - RNA, 20 nt, Artificial Sequence
  mmSKRIPTE0008095_Apobec1_3
  gRNA
cgcagcaacauaagcucccg

SEQ ID NO: 137317 - RNA, 20 nt, Artificial Sequence
  mmSKRIPTE0008096_Apobec1_4
  gRNA
uguauuccgagacacuuaag

SEQ ID NO: 137318 - RNA, 20 nt, Artificial Sequence
  mmSKRIPTE0008097_Apobec1_5
  gRNA
acgcugggauggaaucucag

SEQ ID NO: 137319 - RNA, 20 nt, Artificial Sequence
  mmSKRIPTE0008098_Apobec1_6
  gRNA
ucccuaaucuuaccuccccg

SEQ ID NO: 137320 - RNA, 20 nt, Artificial Sequence
  mmSKRIPTE0008099_Apobec1_7
  gRNA
ccacucuuacuugagccuga

SEQ ID NO: 137321 - RNA, 20 nt, Artificial Sequence
  mmSKRIPTE0008100_Apobec1_8
  gRNA
ucucuuuccgaagcucccgg

SEQ ID NO: 137322 - RNA, 20 nt, Artificial Sequence
  mmSKRIPTE0008101_Apobec1_9
  gRNA
ggcgguuucgcugauccgug

SEQ ID NO: 137323 - RNA, 20 nt, Artificial Sequence
  mmSKRIPTE0008102_Foxf1_1
  gRNA
agaagaccaacgccggcgug

SEQ ID NO: 137324 - RNA, 20 nt, Artificial Sequence
  mmSKRIPTE0008103_Foxf1_2
  gRNA
ggcgacugugagugauaccg

SEQ ID NO: 137325 - RNA, 20 nt, Artificial Sequence
  mmSKRIPTE0008104_Foxf1_3
  gRNA
aacucgaccagucuaaacug

SEQ ID NO: 137326 - RNA, 20 nt, Artificial Sequence
  mmSKRIPTE0008105_Foxf1_4
  gRNA
aggaucuucagcucucugcg

SEQ ID NO: 137327 - RNA, 20 nt, Artificial Sequence
  mmSKRIPTE0008106_Foxf1_5
  gRNA
guacccgcaccacgacagcu

SEQ ID NO: 137328 - RNA, 20 nt, Artificial Sequence
  mmSKRIPTE0008107_Foxf1_6
  gRNA
gacaugacacagcaccuccg

SEQ ID NO: 137329 - RNA, 20 nt, Artificial Sequence
  mmSKRIPTE0008108_Foxf1_7
  gRNA
gacaagcagcagccgccgca

SEQ ID NO: 137330 - RNA, 20 nt, Artificial Sequence
  mmSKRIPTE0008109_Foxf1_8
  gRNA
gaagcaagaucgguucacag

SEQ ID NO: 137331 - RNA, 20 nt, Artificial Sequence
  mmSKRIPTE0008110_Foxf1_9
  gRNA
cuuuacaaauaauccguuag

SEQ ID NO: 137332 - RNA, 20 nt, Artificial Sequence
  mmSKRIPTE0008111_Cd244_1
  gRNA
aaguuguaccguguacgagg

SEQ ID NO: 137333 - RNA, 20 nt, Artificial Sequence
  mmSKRIPTE0008112_Cd244_2
  gRNA
cggucagaaacaacgaugug

SEQ ID NO: 137334 - RNA, 20 nt, Artificial Sequence
  mmSKRIPTE0008113_Cd244_3
  gRNA
aaucacgaugaucaccccaa

SEQ ID NO: 137335 - RNA, 20 nt, Artificial Sequence
  mmSKRIPTE0008114_Cd244_4
  gRNA
acauggugccucuaucucca

SEQ ID NO: 137336 - RNA, 20 nt, Artificial Sequence
  mmSKRIPTE0008115_Cd244_5
  gRNA
ucaaugaugcugcaugacac

SEQ ID NO: 137337 - RNA, 20 nt, Artificial Sequence
  mmSKRIPTE0008116_Cd244_6
  gRNA
aaaucuagaaucccgagcag

SEQ ID NO: 137338 - RNA, 20 nt, Artificial Sequence
  mmSKRIPTE0008117_Cd244_7
  gRNA
agugcccccacuuacucgaa

SEQ ID NO: 137339 - RNA, 20 nt, Artificial Sequence
  mmSKRIPTE0008118_Cd244_8
  gRNA
aucaggaugauguacacacu

SEQ ID NO: 137340 - RNA, 20 nt, Artificial Sequence
  mmSKRIPTE0008119_Cd244_9
  gRNA
caaagaagacaaaaucggcu

SEQ ID NO: 137341 - RNA, 20 nt, Artificial Sequence
  mmSKRIPTE0008120_Il2_1
  gRNA
cgaugaugagucagcaacug

SEQ ID NO: 137342 - RNA, 20 nt, Artificial Sequence
  mmSKRIPTE0008121_Il2_2
  gRNA
cuccacuucaagcucuacag

SEQ ID NO: 137343 - RNA, 20 nt, Artificial Sequence
  mmSKRIPTE0008122_Il2_3
  gRNA
uuaggacaagcaucuauugg

SEQ ID NO: 137344 - RNA, 20 nt, Artificial Sequence
  mmSKRIPTE0008123_Il2_4
  gRNA
acugugaggagugauuagca

SEQ ID NO: 137345 - RNA, 20 nt, Artificial Sequence
  mmSKRIPTE0008124_Il2_5
  gRNA
accucagucccccuuuacag

SEQ ID NO: 137346 - RNA, 20 nt, Artificial Sequence
  mmSKRIPTE0008125_Il2_6
  gRNA
uccauucagucaguguaugg

SEQ ID NO: 137347 - RNA, 20 nt, Artificial Sequence
  mmSKRIPTE0008126_Il2_7
  gRNA
cuguuguaaaacuaaaggua

SEQ ID NO: 137348 - RNA, 20 nt, Artificial Sequence
  mmSKRIPTE0008127_Il2_8
  gRNA
caagugaauccuuccacugu

SEQ ID NO: 137349 - RNA, 20 nt, Artificial Sequence
  mmSKRIPTE0008128_Il2_9
  gRNA
aagugggugcgcuguugaca

SEQ ID NO: 137350 - RNA, 20 nt, Artificial Sequence
  mmSKRIPTE0008129_Spon2_1
  gRNA
gauucccgucuguaacccug

SEQ ID NO: 137351 - RNA, 20 nt, Artificial Sequence
  mmSKRIPTE0008130_Spon2_2
  gRNA
ucgccaaagugaccuucgug

SEQ ID NO: 137352 - RNA, 20 nt, Artificial Sequence
  mmSKRIPTE0008131_Spon2_3
  gRNA
ggggacaaugcguaccacga

SEQ ID NO: 137353 - RNA, 20 nt, Artificial Sequence
  mmSKRIPTE0008132_Spon2_4
  gRNA
gcguuccacuguuaaccuga

SEQ ID NO: 137354 - RNA, 20 nt, Artificial Sequence
  mmSKRIPTE0008133_Spon2_5
  gRNA
aagucugcccgguaccgcua

SEQ ID NO: 137355 - RNA, 20 nt, Artificial Sequence
  mmSKRIPTE0008134_Spon2_6
  gRNA
cuauagacuuuaaucccacg

SEQ ID NO: 137356 - RNA, 20 nt, Artificial Sequence
  mmSKRIPTE0008135_Spon2_7
  gRNA
cacaauguagagcggccagg

SEQ ID NO: 137357 - RNA, 20 nt, Artificial Sequence
  mmSKRIPTE0008136_Spon2_8
  gRNA
gcagcucuuaggaucccuca

SEQ ID NO: 137358 - RNA, 20 nt, Artificial Sequence
  mmSKRIPTE0008137_Spon2_9
  gRNA
ggcaucugggaaacucucga

SEQ ID NO: 137359 - RNA, 20 nt, Artificial Sequence
  mmSKRIPTE0008138_Tnfsf18_1
  gRNA
aggaugcacgggcuuuccga

SEQ ID NO: 137360 - RNA, 20 nt, Artificial Sequence
  mmSKRIPTE0008139_Tnfsf18_2
  gRNA
ucuucauuagaccauucaca

SEQ ID NO: 137361 - RNA, 20 nt, Artificial Sequence
  mmSKRIPTE0008140_Tnfsf18_3
  gRNA
augcaggacucgauggcagu

SEQ ID NO: 137362 - RNA, 20 nt, Artificial Sequence
  mmSKRIPTE0008141_Tnfsf18_4
  gRNA
gaugucguauucacacagug

SEQ ID NO: 137363 - RNA, 20 nt, Artificial Sequence
  mmSKRIPTE0008142_Tnfsf18_5
  gRNA
agugcuuagcaguguuccaa

SEQ ID NO: 137364 - RNA, 20 nt, Artificial Sequence
  mmSKRIPTE0008143_Tnfsf18_6
  gRNA
ucagcauugcuagagguagu

SEQ ID NO: 137365 - RNA, 20 nt, Artificial Sequence
  mmSKRIPTE0008144_Tnfsf18_7
  gRNA
gaugcaucgacuuuacccca

SEQ ID NO: 137366 - RNA, 20 nt, Artificial Sequence
  mmSKRIPTE0008145_Tnfsf18_8
  gRNA
gaaacauuguuagacuggug

SEQ ID NO: 137367 - RNA, 20 nt, Artificial Sequence
  mmSKRIPTE0008146_Tnfsf18_9
  gRNA
cuacggccaagugauuccug

SEQ ID NO: 137368 - RNA, 20 nt, Artificial Sequence
  mmSKRIPTE0008147_Ace_1
  gRNA
cuuacccgugacuuuccggg

SEQ ID NO: 137369 - RNA, 20 nt, Artificial Sequence
  mmSKRIPTE0008148_Ace_2
  gRNA
gcccugaaccagcuccagcg

SEQ ID NO: 137370 - RNA, 20 nt, Artificial Sequence
  mmSKRIPTE0008149_Ace_3
  gRNA
auggcacguucgcaggaacg

SEQ ID NO: 137371 - RNA, 20 nt, Artificial Sequence
  mmSKRIPTE0008150_Ace_4
  gRNA
aaguuuaaacaugagccgga

SEQ ID NO: 137372 - RNA, 20 nt, Artificial Sequence
  mmSKRIPTE0008151_Ace_5
  gRNA
acggauguuguagagccgau

SEQ ID NO: 137373 - RNA, 20 nt, Artificial Sequence
  mmSKRIPTE0008152_Ace_6
  gRNA
guuguugaacgaguacgcag

SEQ ID NO: 137374 - RNA, 20 nt, Artificial Sequence
  mmSKRIPTE0008153_Ace_7
  gRNA
ugggcgagacaaccuuacag

SEQ ID NO: 137375 - RNA, 20 nt, Artificial Sequence
  mmSKRIPTE0008154_Ace_8
  gRNA
acaggcccaggaaauugacg

SEQ ID NO: 137376 - RNA, 20 nt, Artificial Sequence
  mmSKRIPTE0008155_Ace_9
  gRNA
ugcaaggagcaugacgugau

SEQ ID NO: 137377 - RNA, 20 nt, Artificial Sequence
  mmSKRIPTE0008156_Sos2_1
  gRNA
augagcagacuuacaaaucg

SEQ ID NO: 137378 - RNA, 20 nt, Artificial Sequence
  mmSKRIPTE0008157_Sos2_2
  gRNA
aaaggcuucgcuaccaacgc

SEQ ID NO: 137379 - RNA, 20 nt, Artificial Sequence
  mmSKRIPTE0008158_Sos2_3
  gRNA
agcucgcacaacuuguaacg

SEQ ID NO: 137380 - RNA, 20 nt, Artificial Sequence
  mmSKRIPTE0008159_Sos2_4
  gRNA
ucuaccucaggcacgcuacg

SEQ ID NO: 137381 - RNA, 20 nt, Artificial Sequence
  mmSKRIPTE0008160_Sos2_5
  gRNA
ucacaacuuggccuaauacg

SEQ ID NO: 137382 - RNA, 20 nt, Artificial Sequence
  mmSKRIPTE0008161_Sos2_6
  gRNA
gaaaacagcccgaaauggcg

SEQ ID NO: 137383 - RNA, 20 nt, Artificial Sequence
  mmSKRIPTE0008162_Sos2_7
  gRNA
ccuuucaggaguuagaacgc

SEQ ID NO: 137384 - RNA, 20 nt, Artificial Sequence
  mmSKRIPTE0008163_Sos2_8
  gRNA
gcugcuuaauaagcuaugca

SEQ ID NO: 137385 - RNA, 20 nt, Artificial Sequence
  mmSKRIPTE0008164_Sos2_9
  gRNA
ugggauuuacaaugacacca

SEQ ID NO: 137386 - RNA, 20 nt, Artificial Sequence
  mmSKRIPTE0008165_Il1f5_1
  gRNA
gcagugugacuagggcugcg

SEQ ID NO: 137387 - RNA, 20 nt, Artificial Sequence
  mmSKRIPTE0008166_Il1f5_2
  gRNA
aggcuggucagcuuccggug

SEQ ID NO: 137388 - RNA, 20 nt, Artificial Sequence
  mmSKRIPTE0008167_Il1f5_3
  gRNA
ccaaagguacuuagacugug

SEQ ID NO: 137389 - RNA, 20 nt, Artificial Sequence
  mmSKRIPTE0008168_Il1f5_4
  gRNA
aauacaccaaugauccaggg

SEQ ID NO: 137390 - RNA, 20 nt, Artificial Sequence
  mmSKRIPTE0008169_Il1f5_5
  gRNA
uucucuggcccugaaccgag

SEQ ID NO: 137391 - RNA, 20 nt, Artificial Sequence
  mmSKRIPTE0008170_Il1f5_6
  gRNA
uggcaauuuaucaucacgag

SEQ ID NO: 137392 - RNA, 20 nt, Artificial Sequence
  mmSKRIPTE0008171_Il1f5_7
  gRNA
uugaacgcccaggaugacag

SEQ ID NO: 137393 - RNA, 20 nt, Artificial Sequence
  mmSKRIPTE0008172_Il1f5_8
  gRNA
caucauggagcucuaccucg

SEQ ID NO: 137394 - RNA, 20 nt, Artificial Sequence
  mmSKRIPTE0008173_Il1f5_9
  gRNA
gaacccaauagaaaccacgu

SEQ ID NO: 137395 - RNA, 20 nt, Artificial Sequence
  mmSKRIPTE0008174_Twist2_1
  gRNA
aaaacugaaagugccgcccg

SEQ ID NO: 137396 - RNA, 20 nt, Artificial Sequence
  mmSKRIPTE0008175_Twist2_2
  gRNA
agaaaacucuccuaccccgg

SEQ ID NO: 137397 - RNA, 20 nt, Artificial Sequence
  mmSKRIPTE0008176_Twist2_3
  gRNA
acaggcggguggauuccgaa

SEQ ID NO: 137398 - RNA, 20 nt, Artificial Sequence
  mmSKRIPTE0008177_Twist2_4
  gRNA
uccccucgaagaucuaagca

SEQ ID NO: 137399 - RNA, 20 nt, Artificial Sequence
  mmSKRIPTE0008178_Twist2_5
  gRNA
augagcgcgaggcaacaggu

SEQ ID NO: 137400 - RNA, 20 nt, Artificial Sequence
  mmSKRIPTE0008179_Twist2_6
  gRNA
auaaaauagucguaucccag

SEQ ID NO: 137401 - RNA, 20 nt, Artificial Sequence
  mmSKRIPTE0008180_Twist2_7
  gRNA
aaacgucuuccuuaggccag

SEQ ID NO: 137402 - RNA, 20 nt, Artificial Sequence
  mmSKRIPTE0008181_Twist2_8
  gRNA
gcgcacccagucgcucaacg

SEQ ID NO: 137403 - RNA, 20 nt, Artificial Sequence
  mmSKRIPTE0008182_Twist2_9
  gRNA
cagagccuuugagagcgacc

SEQ ID NO: 137404 - RNA, 20 nt, Artificial Sequence
  mmSKRIPTE0008183_H60c_1
  gRNA
aguguggcgacgauuuguug

SEQ ID NO: 137405 - RNA, 20 nt, Artificial Sequence
  mmSKRIPTE0008184_H60c_2
  gRNA
cacaucguauaaagggucug

SEQ ID NO: 137406 - RNA, 20 nt, Artificial Sequence
  mmSKRIPTE0008185_H60c_3
  gRNA
gacuugcaugccauggaucg

SEQ ID NO: 137407 - RNA, 20 nt, Artificial Sequence
  mmSKRIPTE0008186_H60c_4
  gRNA
auguugaggaugacgaaaag

SEQ ID NO: 137408 - RNA, 20 nt, Artificial Sequence
  mmSKRIPTE0008187_H60c_5
  gRNA
cuggauagaaagaaucaucg

SEQ ID NO: 137409 - RNA, 20 nt, Artificial Sequence
  mmSKRIPTE0008188_H60c_6
  gRNA
ucauuaucaacccaucaaag

SEQ ID NO: 137410 - RNA, 20 nt, Artificial Sequence
  mmSKRIPTE0008189_H60c_7
  gRNA
uuagguuaguaggacuccac

SEQ ID NO: 137411 - RNA, 20 nt, Artificial Sequence
  mmSKRIPTE0008190_H60c_8
  gRNA
auguucagucuugauaggag

SEQ ID NO: 137412 - RNA, 20 nt, Artificial Sequence
  mmSKRIPTE0008191_H60c_9
  gRNA
cuguugcacagcaaaagggg

SEQ ID NO: 137413 - RNA, 20 nt, Artificial Sequence
  mmSKRIPTE0008192_Nlrp1a_1
  gRNA
uaaccaagggaagcuuaacg

SEQ ID NO: 137414 - RNA, 20 nt, Artificial Sequence
  mmSKRIPTE0008193_Nlrp1a_2
  gRNA
aaugcacugaguguuagugu

SEQ ID NO: 137415 - RNA, 20 nt, Artificial Sequence
  mmSKRIPTE0008194_Nlrp1a_3
  gRNA
uggaggaagacacgauauag

SEQ ID NO: 137416 - RNA, 20 nt, Artificial Sequence
  mmSKRIPTE0008195_Nlrp1a_4
  gRNA
caaugacugcaguauucgaa

SEQ ID NO: 137417 - RNA, 20 nt, Artificial Sequence
  mmSKRIPTE0008196_Nlrp1a_5
  gRNA
uguacgacccugagaaagcg

SEQ ID NO: 137418 - RNA, 20 nt, Artificial Sequence
  mmSKRIPTE0008197_Nlrp1a_6
  gRNA
ucggcaaugguagauuacug

SEQ ID NO: 137419 - RNA, 20 nt, Artificial Sequence
  mmSKRIPTE0008198_Nlrp1a_7
  gRNA
agaaaccuaucugcuaugug

SEQ ID NO: 137420 - RNA, 20 nt, Artificial Sequence
  mmSKRIPTE0008199_Nlrp1a_8
  gRNA
gauggucccuacgaugaaca

SEQ ID NO: 137421 - RNA, 20 nt, Artificial Sequence
  mmSKRIPTE0008200_Nlrp1a_9
  gRNA
ucaucauagagaguagaccu

SEQ ID NO: 137422 - RNA, 20 nt, Artificial Sequence
  mmSKRIPTE0008201_Gadd45g_1
  gRNA
ccgggaagaaccgaccagcg

SEQ ID NO: 137423 - RNA, 20 nt, Artificial Sequence
  mmSKRIPTE0008202_Gadd45g_2
  gRNA
gcucgugccagaaggccacg

SEQ ID NO: 137424 - RNA, 20 nt, Artificial Sequence
  mmSKRIPTE0008203_Gadd45g_3
  gRNA
gaaagaacaagcgccgugag

SEQ ID NO: 137425 - RNA, 20 nt, Artificial Sequence
  mmSKRIPTE0008204_Gadd45g_4
  gRNA
ucaccaagucgaucagacca

SEQ ID NO: 137426 - RNA, 20 nt, Artificial Sequence
  mmSKRIPTE0008205_Gadd45g_5
  gRNA
aaggauguuucacggcaccu

SEQ ID NO: 137427 - RNA, 20 nt, Artificial Sequence
  mmSKRIPTE0008206_Gadd45g_6
  gRNA
gacauugauaucgugcgcgu

SEQ ID NO: 137428 - RNA, 20 nt, Artificial Sequence
  mmSKRIPTE0008207_Gadd45g_7
  gRNA
ggcggacucguagacgccag

SEQ ID NO: 137429 - RNA, 20 nt, Artificial Sequence
  mmSKRIPTE0008208_Gadd45g_8
  gRNA
aguuauccaaaagagugcgg

SEQ ID NO: 137430 - RNA, 20 nt, Artificial Sequence
  mmSKRIPTE0008209_Gadd45g_9
  gRNA
ccugcaaacuucuauccuag

SEQ ID NO: 137431 - RNA, 20 nt, Artificial Sequence
  mmSKRIPTE0008210_Rac2_1
  gRNA
aagcugugucaacccgagag

SEQ ID NO: 137432 - RNA, 20 nt, Artificial Sequence
  mmSKRIPTE0008211_Rac2_2
  gRNA
ucuugggacuugauccuccg

SEQ ID NO: 137433 - RNA, 20 nt, Artificial Sequence
  mmSKRIPTE0008212_Rac2_3
  gRNA
uggacaccagugguauggag

SEQ ID NO: 137434 - RNA, 20 nt, Artificial Sequence
  mmSKRIPTE0008213_Rac2_4
  gRNA
ugagaaaggcuagcaucucg

SEQ ID NO: 137435 - RNA, 20 nt, Artificial Sequence
  mmSKRIPTE0008214_Rac2_5
  gRNA
ucaaucuauggucaagaccg

SEQ ID NO: 137436 - RNA, 20 nt, Artificial Sequence
  mmSKRIPTE0008215_Rac2_6
  gRNA
gaccuccuacucuacuugaa

SEQ ID NO: 137437 - RNA, 20 nt, Artificial Sequence
  mmSKRIPTE0008216_Rac2_7
  gRNA
cacaaauugcaaaaguaucg

SEQ ID NO: 137438 - RNA, 20 nt, Artificial Sequence
  mmSKRIPTE0008217_Rac2_8
  gRNA
uuuaacuccccaaagcgaug

SEQ ID NO: 137439 - RNA, 20 nt, Artificial Sequence
  mmSKRIPTE0008218_Rac2_9
  gRNA
cuauaacccccgacugucag

SEQ ID NO: 137440 - RNA, 20 nt, Artificial Sequence
  mmSKRIPTE0008219_Trim15_1
  gRNA
gggucggugaauaaucccac

SEQ ID NO: 137441 - RNA, 20 nt, Artificial Sequence
  mmSKRIPTE0008220_Trim15_2
  gRNA
auguuguggacacaccaccg

SEQ ID NO: 137442 - RNA, 20 nt, Artificial Sequence
  mmSKRIPTE0008221_Trim15_3
  gRNA
uguuaaaggacugguccgaa

SEQ ID NO: 137443 - RNA, 20 nt, Artificial Sequence
  mmSKRIPTE0008222_Trim15_4
  gRNA
ucauuuaucuacguucugag

SEQ ID NO: 137444 - RNA, 20 nt, Artificial Sequence
  mmSKRIPTE0008223_Trim15_5
  gRNA
cagauucagguaaucaacaa

SEQ ID NO: 137445 - RNA, 20 nt, Artificial Sequence
  mmSKRIPTE0008224_Trim15_6
  gRNA
cucaaauggauuuauagugu

SEQ ID NO: 137446 - RNA, 20 nt, Artificial Sequence
  mmSKRIPTE0008225_Trim15_7
  gRNA
aacuucccaaggcaugcacg

SEQ ID NO: 137447 - RNA, 20 nt, Artificial Sequence
  mmSKRIPTE0008226_Trim15_8
  gRNA
gcugaggcgcugcuucgugg

SEQ ID NO: 137448 - RNA, 20 nt, Artificial Sequence
  mmSKRIPTE0008227_Trim15_9
  gRNA
cuccuacagauacucccaag

SEQ ID NO: 137449 - RNA, 20 nt, Artificial Sequence
  mmSKRIPTE0008228_Csf1_1
  gRNA
gugccaagcagcgaccaccc

SEQ ID NO: 137450 - RNA, 20 nt, Artificial Sequence
  mmSKRIPTE0008229_Csf1_2
  gRNA
augacagcccgaacgguaga

SEQ ID NO: 137451 - RNA, 20 nt, Artificial Sequence
  mmSKRIPTE0008230_Csf1_3
  gRNA
ggauucggugucgcaauaug

SEQ ID NO: 137452 - RNA, 20 nt, Artificial Sequence
  mmSKRIPTE0008231_Csf1_4
  gRNA
gaacagcuaaaagaugagcg

SEQ ID NO: 137453 - RNA, 20 nt, Artificial Sequence
  mmSKRIPTE0008232_Csf1_5
  gRNA
gaagcaguaacugagcaacg

SEQ ID NO: 137454 - RNA, 20 nt, Artificial Sequence
  mmSKRIPTE0008233_Csf1_6
  gRNA
auagauggaauccacgugca

SEQ ID NO: 137455 - RNA, 20 nt, Artificial Sequence
  mmSKRIPTE0008234_Csf1_7
  gRNA
cagcuuugccuacauaagga

SEQ ID NO: 137456 - RNA, 20 nt, Artificial Sequence
  mmSKRIPTE0008235_Csf1_8
  gRNA
cugguggucuucacgcagcg

SEQ ID NO: 137457 - RNA, 20 nt, Artificial Sequence
  mmSKRIPTE0008236_Csf1_9
  gRNA
agacgugaugaugaauguau

SEQ ID NO: 137458 - RNA, 20 nt, Artificial Sequence
  mmSKRIPTE0008237_Shh_1
  gRNA
auaaggaagcaaaaaccccg

SEQ ID NO: 137459 - RNA, 20 nt, Artificial Sequence
  mmSKRIPTE0008238_Shh_2
  gRNA
ccuagcacuccucuuccggg

SEQ ID NO: 137460 - RNA, 20 nt, Artificial Sequence
  mmSKRIPTE0008239_Shh_3
  gRNA
ucgcugguaacggaacacau

SEQ ID NO: 137461 - RNA, 20 nt, Artificial Sequence
  mmSKRIPTE0008240_Shh_4
  gRNA
gugaagcugcgagugaccga

SEQ ID NO: 137462 - RNA, 20 nt, Artificial Sequence
  mmSKRIPTE0008241_Shh_5
  gRNA
gcacagcgugacgcugcgag

SEQ ID NO: 137463 - RNA, 20 nt, Artificial Sequence
  mmSKRIPTE0008242_Shh_6
  gRNA
gcgcgcguucaugucucacu

SEQ ID NO: 137464 - RNA, 20 nt, Artificial Sequence
  mmSKRIPTE0008243_Shh_7
  gRNA
ccguugcagauugcgcugca

SEQ ID NO: 137465 - RNA, 20 nt, Artificial Sequence
  mmSKRIPTE0008244_Shh_8
  gRNA
uacgugguggcugaacgcgg

SEQ ID NO: 137466 - RNA, 20 nt, Artificial Sequence
  mmSKRIPTE0008245_Shh_9
  gRNA
acacuaugagggucgagcag

SEQ ID NO: 137467 - RNA, 20 nt, Artificial Sequence
  mmSKRIPTE0008246_Swap70_1
  gRNA
aucagcgcauuggccuaaag

SEQ ID NO: 137468 - RNA, 20 nt, Artificial Sequence
  mmSKRIPTE0008247_Swap70_2
  gRNA
cagcaacuaugcacgcaggg

SEQ ID NO: 137469 - RNA, 20 nt, Artificial Sequence
  mmSKRIPTE0008248_Swap70_3
  gRNA
cacguggguaagguguuacg

SEQ ID NO: 137470 - RNA, 20 nt, Artificial Sequence
  mmSKRIPTE0008249_Swap70_4
  gRNA
ucccuacauccuuagccgaa

SEQ ID NO: 137471 - RNA, 20 nt, Artificial Sequence
  mmSKRIPTE0008250_Swap70_5
  gRNA
auaauauguaacaccagucg

SEQ ID NO: 137472 - RNA, 20 nt, Artificial Sequence
  mmSKRIPTE0008251_Swap70_6
  gRNA
cagaccaggcaaucggccaa

SEQ ID NO: 137473 - RNA, 20 nt, Artificial Sequence
  mmSKRIPTE0008252_Swap70_7
  gRNA
uggcaccuacuguacacccg

SEQ ID NO: 137474 - RNA, 20 nt, Artificial Sequence
  mmSKRIPTE0008253_Swap70_8
  gRNA
guuacagauuccaacuagug

SEQ ID NO: 137475 - RNA, 20 nt, Artificial Sequence
  mmSKRIPTE0008254_Swap70_9
  gRNA
uuaauacgauugauagaacc

SEQ ID NO: 137476 - RNA, 20 nt, Artificial Sequence
  mmSKRIPTE0008255_Jaml_1
  gRNA
ccaaccuuagcgugccuacg

SEQ ID NO: 137477 - RNA, 20 nt, Artificial Sequence
  mmSKRIPTE0008256_Jaml_2
  gRNA
uaugacuccaacaugcguag

SEQ ID NO: 137478 - RNA, 20 nt, Artificial Sequence
  mmSKRIPTE0008257_Jaml_3
  gRNA
uggaucuguaacgugaacag

SEQ ID NO: 137479 - RNA, 20 nt, Artificial Sequence
  mmSKRIPTE0008258_Jaml_4
  gRNA
augcugggucacggacggag

SEQ ID NO: 137480 - RNA, 20 nt, Artificial Sequence
  mmSKRIPTE0008259_Jaml_5
  gRNA
gugcuaccagaggaaccuaa

SEQ ID NO: 137481 - RNA, 20 nt, Artificial Sequence
  mmSKRIPTE0008260_Jaml_6
  gRNA
ccagaucucagaguccgagu

SEQ ID NO: 137482 - RNA, 20 nt, Artificial Sequence
  mmSKRIPTE0008261_Jaml_7
  gRNA
gcccuguggauaaccuacag

SEQ ID NO: 137483 - RNA, 20 nt, Artificial Sequence
  mmSKRIPTE0008262_Jaml_8
  gRNA
gguaagaccaggcucaguug

SEQ ID NO: 137484 - RNA, 20 nt, Artificial Sequence
  mmSKRIPTE0008263_Jaml_9
  gRNA
uauaacccauagcugcgcca

SEQ ID NO: 137485 - RNA, 20 nt, Artificial Sequence
  mmSKRIPTE0008264_Xcl1_1
  gRNA
gcacagcgauaacccugacu

SEQ ID NO: 137486 - RNA, 20 nt, Artificial Sequence
  mmSKRIPTE0008265_Xcl1_2
  gRNA
ugcacaaggaaagauaucgu

SEQ ID NO: 137487 - RNA, 20 nt, Artificial Sequence
  mmSKRIPTE0008266_Xcl1_3
  gRNA
cccucugagaagaaaucccg

SEQ ID NO: 137488 - RNA, 20 nt, Artificial Sequence
  mmSKRIPTE0008267_Xcl1_4
  gRNA
gaugagcugcuuaacgagug

SEQ ID NO: 137489 - RNA, 20 nt, Artificial Sequence
  mmSKRIPTE0008268_Xcl1_5
  gRNA
gugugaacuuacaaacccag

SEQ ID NO: 137490 - RNA, 20 nt, Artificial Sequence
  mmSKRIPTE0008269_Xcl1_6
  gRNA
cucaccccauggguugugga

SEQ ID NO: 137491 - RNA, 20 nt, Artificial Sequence
  mmSKRIPTE0008270_Xcl1_7
  gRNA
ucuagaaaaaugggucagcg

SEQ ID NO: 137492 - RNA, 20 nt, Artificial Sequence
  mmSKRIPTE0008271_Xcl1_8
  gRNA
uauaaugcacaagugacucg

SEQ ID NO: 137493 - RNA, 20 nt, Artificial Sequence
  mmSKRIPTE0008272_Xcl1_9
  gRNA
uucagcauaggauauuggcu

SEQ ID NO: 137494 - RNA, 20 nt, Artificial Sequence
  mmSKRIPTE0008273_Irgm1_1
  gRNA
cugcauaguagucuucaaag

SEQ ID NO: 137495 - RNA, 20 nt, Artificial Sequence
  mmSKRIPTE0008274_Irgm1_2
  gRNA
ggccacagcccaaaccguag

SEQ ID NO: 137496 - RNA, 20 nt, Artificial Sequence
  mmSKRIPTE0008275_Irgm1_3
  gRNA
augcauuagaaucgagacag

SEQ ID NO: 137497 - RNA, 20 nt, Artificial Sequence
  mmSKRIPTE0008276_Irgm1_4
  gRNA
ugcugacucaccgucaacag

SEQ ID NO: 137498 - RNA, 20 nt, Artificial Sequence
  mmSKRIPTE0008277_Irgm1_5
  gRNA
acagcugcacaaccaucccc

SEQ ID NO: 137499 - RNA, 20 nt, Artificial Sequence
  mmSKRIPTE0008278_Irgm1_6
  gRNA
uuaaacagcagcauacgcau

SEQ ID NO: 137500 - RNA, 20 nt, Artificial Sequence
  mmSKRIPTE0008279_Irgm1_7
  gRNA
ccuuauacuagaucugcgga

SEQ ID NO: 137501 - RNA, 20 nt, Artificial Sequence
  mmSKRIPTE0008280_Irgm1_8
  gRNA
acauagggaacuucugccgg

SEQ ID NO: 137502 - RNA, 20 nt, Artificial Sequence
  mmSKRIPTE0008281_Irgm1_9
  gRNA
caagaggaggucugaucgcg

SEQ ID NO: 137503 - RNA, 20 nt, Artificial Sequence
  mmSKRIPTE0008282_Secum1a_1
  gRNA
ggcagaagcccaucuagggu

SEQ ID NO: 137504 - RNA, 20 nt, Artificial Sequence
  mmSKRIPTE0008283_Secum1a_2
  gRNA
acccagcagacucaguacca

SEQ ID NO: 137505 - RNA, 20 nt, Artificial Sequence
  mmSKRIPTE0008284_Secum1a_3
  gRNA
gccgaucgucaagagcugug

SEQ ID NO: 137506 - RNA, 20 nt, Artificial Sequence
  mmSKRIPTE0008285_Secum1a_4
  gRNA
aucacugcaggauugccucg

SEQ ID NO: 137507 - RNA, 20 nt, Artificial Sequence
  mmSKRIPTE0008286_Secum1a_5
  gRNA
gcugaguguucuuagcuagg

SEQ ID NO: 137508 - RNA, 20 nt, Artificial Sequence
  mmSKRIPTE0008287_Secum1a_6
  gRNA
aggcuaggacuacucccacc

SEQ ID NO: 137509 - RNA, 20 nt, Artificial Sequence
  mmSKRIPTE0008288_Secum1a_7
  gRNA
cuacugaggucauaaucgau

SEQ ID NO: 137510 - RNA, 20 nt, Artificial Sequence
  mmSKRIPTE0008289_Secum1a_8
  gRNA
acuuaaucuguccugcggug

SEQ ID NO: 137511 - RNA, 20 nt, Artificial Sequence
  mmSKRIPTE0008290_Secum1a_9
  gRNA
uccccgcuaagaagagccaa

SEQ ID NO: 137512 - RNA, 20 nt, Artificial Sequence
  mmSKRIPTE0008291_Ighg2b_1
  gRNA
acccagcaucuugagugggu

SEQ ID NO: 137513 - RNA, 20 nt, Artificial Sequence
  mmSKRIPTE0008292_Ighg2b_2
  gRNA
agacggaugguccacccucg

SEQ ID NO: 137514 - RNA, 20 nt, Artificial Sequence
  mmSKRIPTE0008293_Ighg2b_3
  gRNA
gacaagcacaccuaucccag

SEQ ID NO: 137515 - RNA, 20 nt, Artificial Sequence
  mmSKRIPTE0008294_Ighg2b_4
  gRNA
cucauggugauccuuaugug

SEQ ID NO: 137516 - RNA, 20 nt, Artificial Sequence
  mmSKRIPTE0008295_Ighg2b_5
  gRNA
ucaugcaacgugagacacga

SEQ ID NO: 137517 - RNA, 20 nt, Artificial Sequence
  mmSKRIPTE0008296_Ighg2b_6
  gRNA
uacaccacugaguacuggcu

SEQ ID NO: 137518 - RNA, 20 nt, Artificial Sequence
  mmSKRIPTE0008297_Ighg2b_7
  gRNA
ccagggucacaauagcccaa

SEQ ID NO: 137519 - RNA, 20 nt, Artificial Sequence
  mmSKRIPTE0008298_Ighg2b_8
  gRNA
agaaucucuccaaauauccg

SEQ ID NO: 137520 - RNA, 20 nt, Artificial Sequence
  mmSKRIPTE0008299_Ighg2b_9
  gRNA
ucagacccuccaauccugug

SEQ ID NO: 137521 - RNA, 20 nt, Artificial Sequence
  mmSKRIPTE0008300_Dusp22_1
  gRNA
gcgugccccuuugagagcgg

SEQ ID NO: 137522 - RNA, 20 nt, Artificial Sequence
  mmSKRIPTE0008301_Dusp22_2
  gRNA
ugaaacgaagcacuuacgug

SEQ ID NO: 137523 - RNA, 20 nt, Artificial Sequence
  mmSKRIPTE0008302_Dusp22_3
  gRNA
ggcauuacuguccggccgug

SEQ ID NO: 137524 - RNA, 20 nt, Artificial Sequence
  mmSKRIPTE0008303_Dusp22_4
  gRNA
ugucugccgcuggaauacac

SEQ ID NO: 137525 - RNA, 20 nt, Artificial Sequence
  mmSKRIPTE0008304_Dusp22_5
  gRNA
ugggugcuuccagaguaggc

SEQ ID NO: 137526 - RNA, 20 nt, Artificial Sequence
  mmSKRIPTE0008305_Dusp22_6
  gRNA
acguuaggaugaccaccaug

SEQ ID NO: 137527 - RNA, 20 nt, Artificial Sequence
  mmSKRIPTE0008306_Dusp22_7
  gRNA
uacgagaggaggucgcagca

SEQ ID NO: 137528 - RNA, 20 nt, Artificial Sequence
  mmSKRIPTE0008307_Dusp22_8
  gRNA
cuaaauaagaucauacacag

SEQ ID NO: 137529 - RNA, 20 nt, Artificial Sequence
  mmSKRIPTE0008308_Dusp22_9
  gRNA
gggaugagccagguaacguc

SEQ ID NO: 137530 - RNA, 20 nt, Artificial Sequence
  mmSKRIPTE0008309_Lmo2_1
  gRNA
cagagcuuaaggccacggga

SEQ ID NO: 137531 - RNA, 20 nt, Artificial Sequence
  mmSKRIPTE0008310_Lmo2_2
  gRNA
uguuuccagagucacccgcg

SEQ ID NO: 137532 - RNA, 20 nt, Artificial Sequence
  mmSKRIPTE0008311_Lmo2_3
  gRNA
gugaagacgccgucucggug

SEQ ID NO: 137533 - RNA, 20 nt, Artificial Sequence
  mmSKRIPTE0008312_Lmo2_4
  gRNA
uguaacugggaucgacccug

SEQ ID NO: 137534 - RNA, 20 nt, Artificial Sequence
  mmSKRIPTE0008313_Lmo2_5
  gRNA
gcggugacuguccuugagcg

SEQ ID NO: 137535 - RNA, 20 nt, Artificial Sequence
  mmSKRIPTE0008314_Lmo2_6
  gRNA
aucuaaucgauaguuaccug

SEQ ID NO: 137536 - RNA, 20 nt, Artificial Sequence
  mmSKRIPTE0008315_Lmo2_7
  gRNA
gugaacaagacaucuacgag

SEQ ID NO: 137537 - RNA, 20 nt, Artificial Sequence
  mmSKRIPTE0008316_Lmo2_8
  gRNA
uaggcaaugcugcaccuagu

SEQ ID NO: 137538 - RNA, 20 nt, Artificial Sequence
  mmSKRIPTE0008317_Lmo2_9
  gRNA
aggggcgaacauguaccggg

SEQ ID NO: 137539 - RNA, 20 nt, Artificial Sequence
  mmSKRIPTE0008318_Iuch_1
  gRNA
ccaucuuagcggagggacug

SEQ ID NO: 137540 - RNA, 20 nt, Artificial Sequence
  mmSKRIPTE0008319_Iuch_2
  gRNA
aauuguguugagcagcguga

SEQ ID NO: 137541 - RNA, 20 nt, Artificial Sequence
  mmSKRIPTE0008320_Iuch_3
  gRNA
uagacguggaguuacgcaug

SEQ ID NO: 137542 - RNA, 20 nt, Artificial Sequence
  mmSKRIPTE0008321_Iuch_4
  gRNA
gcugaguggagguugucucg

SEQ ID NO: 137543 - RNA, 20 nt, Artificial Sequence
  mmSKRIPTE0008322_Iuch_5
  gRNA
gccgugucuacccucuuaca

SEQ ID NO: 137544 - RNA, 20 nt, Artificial Sequence
  mmSKRIPTE0008323_Iuch_6
  gRNA
acacagaagaaccugcacga

SEQ ID NO: 137545 - RNA, 20 nt, Artificial Sequence
  mmSKRIPTE0008324_Iuch_7
  gRNA
aaucuaguggaauaagacga

SEQ ID NO: 137546 - RNA, 20 nt, Artificial Sequence
  mmSKRIPTE0008325_Iuch_8
  gRNA
cacagucuaaugcuaagcca

SEQ ID NO: 137547 - RNA, 20 nt, Artificial Sequence
  mmSKRIPTE0008326_Iuch_9
  gRNA
gugugagcgcgcaucccgug

SEQ ID NO: 137548 - RNA, 20 nt, Artificial Sequence
  mmSKRIPTE0008327_Clec2i_1
  gRNA
gggcaaauguccaguuacgu

SEQ ID NO: 137549 - RNA, 20 nt, Artificial Sequence
  mmSKRIPTE0008328_Clec2i_2
  gRNA
ggaacugaaaaacugcggcg

SEQ ID NO: 137550 - RNA, 20 nt, Artificial Sequence
  mmSKRIPTE0008329_Clec2i_3
  gRNA
ccgaaaguaagcucaugcaa

SEQ ID NO: 137551 - RNA, 20 nt, Artificial Sequence
  mmSKRIPTE0008330_Clec2i_4
  gRNA
aaaaaugaguccccaacgug

SEQ ID NO: 137552 - RNA, 20 nt, Artificial Sequence
  mmSKRIPTE0008331_Clec2i_5
  gRNA
gauccuaucgcugcucaggu

SEQ ID NO: 137553 - RNA, 20 nt, Artificial Sequence
  mmSKRIPTE0008332_Clec2i_6
  gRNA
cuaaugcagaugacuccuca

SEQ ID NO: 137554 - RNA, 20 nt, Artificial Sequence
  mmSKRIPTE0008333_Clec2i_7
  gRNA
uucuguguaggcgaugcuau

SEQ ID NO: 137555 - RNA, 20 nt, Artificial Sequence
  mmSKRIPTE0008334_Clec2i_8
  gRNA
acaaaucuacaaaagaccgu

SEQ ID NO: 137556 - RNA, 20 nt, Artificial Sequence
  mmSKRIPTE0008335_Clec2i_9
  gRNA
uuuccuaaagagauucaagg

SEQ ID NO: 137557 - RNA, 20 nt, Artificial Sequence
  mmSKRIPTE0008336_Hcst_1
  gRNA
gagcgggucagaaggugccg

SEQ ID NO: 137558 - RNA, 20 nt, Artificial Sequence
  mmSKRIPTE0008337_Hcst_2
  gRNA
agcuuccgugaucaucucgg

SEQ ID NO: 137559 - RNA, 20 nt, Artificial Sequence
  mmSKRIPTE0008338_Hcst_3
  gRNA
uuaggaucgucacaagccag

SEQ ID NO: 137560 - RNA, 20 nt, Artificial Sequence
  mmSKRIPTE0008339_Hcst_4
  gRNA
uaggacggaugucaccccga

SEQ ID NO: 137561 - RNA, 20 nt, Artificial Sequence
  mmSKRIPTE0008340_Hcst_5
  gRNA
ucuucccuagggacugcuag

SEQ ID NO: 137562 - RNA, 20 nt, Artificial Sequence
  mmSKRIPTE0008341_Hcst_6
  gRNA
aucuguuacagagaaucucg

SEQ ID NO: 137563 - RNA, 20 nt, Artificial Sequence
  mmSKRIPTE0008342_Hcst_7
  gRNA
ccuuuggagaacaaauaugg

SEQ ID NO: 137564 - RNA, 20 nt, Artificial Sequence
  mmSKRIPTE0008343_Hcst_8
  gRNA
ggaaguccucagaacaguag

SEQ ID NO: 137565 - RNA, 20 nt, Artificial Sequence
  mmSKRIPTE0008344_Hcst_9
  gRNA
aagucagacaucggcaggug

SEQ ID NO: 137566 - RNA, 20 nt, Artificial Sequence
  mmSKRIPTE0008345_Klf13_1
  gRNA
accugaacugaaauagcacg

SEQ ID NO: 137567 - RNA, 20 nt, Artificial Sequence
  mmSKRIPTE0008346_Klf13_2
  gRNA
aguguguucagcacucacgc

SEQ ID NO: 137568 - RNA, 20 nt, Artificial Sequence
  mmSKRIPTE0008347_Klf13_3
  gRNA
agggaugaacgcgguccacg

SEQ ID NO: 137569 - RNA, 20 nt, Artificial Sequence
  mmSKRIPTE0008348_Klf13_4
  gRNA
acuccuuugccuugacaucg

SEQ ID NO: 137570 - RNA, 20 nt, Artificial Sequence
  mmSKRIPTE0008349_Klf13_5
  gRNA
aaucuucucauggaacacga

SEQ ID NO: 137571 - RNA, 20 nt, Artificial Sequence
  mmSKRIPTE0008350_Klf13_6
  gRNA
guuuauacagaaccaucgug

SEQ ID NO: 137572 - RNA, 20 nt, Artificial Sequence
  mmSKRIPTE0008351_Klf13_7
  gRNA
ggagugguccugcaucacau

SEQ ID NO: 137573 - RNA, 20 nt, Artificial Sequence
  mmSKRIPTE0008352_Klf13_8
  gRNA
guuguguagugucagucucg

SEQ ID NO: 137574 - RNA, 20 nt, Artificial Sequence
  mmSKRIPTE0008353_Klf13_9
  gRNA
cugagcaaacugguaaugca

SEQ ID NO: 137575 - RNA, 20 nt, Artificial Sequence
  mmSKRIPTE0008354_Plscr1_1
  gRNA
ucgcggaucugugcgcacaa

SEQ ID NO: 137576 - RNA, 20 nt, Artificial Sequence
  mmSKRIPTE0008355_Plscr1_2
  gRNA
gugccgcgauggccuaugaa

SEQ ID NO: 137577 - RNA, 20 nt, Artificial Sequence
  mmSKRIPTE0008356_Plscr1_3
  gRNA
cgguucgaauaauugagugu

SEQ ID NO: 137578 - RNA, 20 nt, Artificial Sequence
  mmSKRIPTE0008357_Plscr1_4
  gRNA
cccggcuuucccucgcagag

SEQ ID NO: 137579 - RNA, 20 nt, Artificial Sequence
  mmSKRIPTE0008358_Plscr1_5
  gRNA
uuguaggggagcuaauauga

SEQ ID NO: 137580 - RNA, 20 nt, Artificial Sequence
  mmSKRIPTE0008359_Plscr1_6
  gRNA
ugaaaagaacguaucccgau

SEQ ID NO: 137581 - RNA, 20 nt, Artificial Sequence
  mmSKRIPTE0008360_Plscr1_7
  gRNA
ugggcgcgggagaugcggau

SEQ ID NO: 137582 - RNA, 20 nt, Artificial Sequence
  mmSKRIPTE0008361_Plscr1_8
  gRNA
uuugaguaaguagaucagcc

SEQ ID NO: 137583 - RNA, 20 nt, Artificial Sequence
  mmSKRIPTE0008362_Plscr1_9
  gRNA
cucaucacccaaauacacaa

SEQ ID NO: 137584 - RNA, 20 nt, Artificial Sequence
  mmSKRIPTE0008363_Ccl22_1
  gRNA
ugacagucaugacacugacc

SEQ ID NO: 137585 - RNA, 20 nt, Artificial Sequence
  mmSKRIPTE0008364_Ccl22_2
  gRNA
ucugccaucacguuuaguga

SEQ ID NO: 137586 - RNA, 20 nt, Artificial Sequence
  mmSKRIPTE0008365_Ccl22_3
  gRNA
aaaggcggggaacuacucag

SEQ ID NO: 137587 - RNA, 20 nt, Artificial Sequence
  mmSKRIPTE0008366_Ccl22_4
  gRNA
gguccaaugucuacgcucug

SEQ ID NO: 137588 - RNA, 20 nt, Artificial Sequence
  mmSKRIPTE0008367_Ccl22_5
  gRNA
gucaggugucuaaugaccag

SEQ ID NO: 137589 - RNA, 20 nt, Artificial Sequence
  mmSKRIPTE0008368_Ccl22_6
  gRNA
aggucccuauggugccaaug

SEQ ID NO: 137590 - RNA, 20 nt, Artificial Sequence
  mmSKRIPTE0008369_Ccl22_7
  gRNA
gucaucuccaaggcccgugg

SEQ ID NO: 137591 - RNA, 20 nt, Artificial Sequence
  mmSKRIPTE0008370_Ccl22_8
  gRNA
gggcaucaaaacaaggacgc

SEQ ID NO: 137592 - RNA, 20 nt, Artificial Sequence
  mmSKRIPTE0008371_Ccl22_9
  gRNA
cuccauaaacuguccuaggg

SEQ ID NO: 137593 - RNA, 20 nt, Artificial Sequence
  mmSKRIPTE0008372_Il18_1
  gRNA
uagugaucggccuauuaagg

SEQ ID NO: 137594 - RNA, 20 nt, Artificial Sequence
  mmSKRIPTE0008373_Il18_2
  gRNA
cuguuauggaaauacaggcg

SEQ ID NO: 137595 - RNA, 20 nt, Artificial Sequence
  mmSKRIPTE0008374_Il18_3
  gRNA
uaaggggugucuggucaacg

SEQ ID NO: 137596 - RNA, 20 nt, Artificial Sequence
  mmSKRIPTE0008375_Il18_4
  gRNA
uccagcucuagaucaagggu

SEQ ID NO: 137597 - RNA, 20 nt, Artificial Sequence
  mmSKRIPTE0008376_Il18_5
  gRNA
caggagcgaugaaaggcucg

SEQ ID NO: 137598 - RNA, 20 nt, Artificial Sequence
  mmSKRIPTE0008377_Il18_6
  gRNA
accugcagaaacguagccaa

SEQ ID NO: 137599 - RNA, 20 nt, Artificial Sequence
  mmSKRIPTE0008378_Il18_7
  gRNA
uggagcuacucuccggccag

SEQ ID NO: 137600 - RNA, 20 nt, Artificial Sequence
  mmSKRIPTE0008379_Il18_8
  gRNA
cugcgguuguacagugaagu

SEQ ID NO: 137601 - RNA, 20 nt, Artificial Sequence
  mmSKRIPTE0008380_Il18_9
  gRNA
uugaucauugcugcaccuag

SEQ ID NO: 137602 - RNA, 20 nt, Artificial Sequence
  mmSKRIPTE0008381_Ighv13-2_1
  gRNA
ggugcagcuuguagagaccg

SEQ ID NO: 137603 - RNA, 20 nt, Artificial Sequence
  mmSKRIPTE0008382_Ighv13-2_2
  gRNA
guucguucaugaccaucagg

SEQ ID NO: 137604 - RNA, 20 nt, Artificial Sequence
  mmSKRIPTE0008383_Ighv13-2_3
  gRNA
uuuguaguagacacacugug

SEQ ID NO: 137605 - RNA, 20 nt, Artificial Sequence
  mmSKRIPTE0008384_Ighv13-2_4
  gRNA
gauuuaugaagggugugagu

SEQ ID NO: 137606 - RNA, 20 nt, Artificial Sequence
  mmSKRIPTE0008385_Ighv13-2_5
  gRNA
acugagcuggguauuucuug

SEQ ID NO: 137607 - RNA, 20 nt, Artificial Sequence
  mmSKRIPTE0008386_Ighv13-2_6
  gRNA
gcuggcgaagccagugcauc

SEQ ID NO: 137608 - RNA, 20 nt, Artificial Sequence
  mmSKRIPTE0008387_Ighv13-2_7
  gRNA
aaacucuccuguguuaccuc

SEQ ID NO: 137609 - RNA, 20 nt, Artificial Sequence
  mmSKRIPTE0008388_Ighv13-2_8
  gRNA
gaacugguacuuugugagaa

SEQ ID NO: 137610 - RNA, 20 nt, Artificial Sequence
  mmSKRIPTE0008389_Ighv13-2_9
  gRNA
ucaacacaaaauaucuauca

SEQ ID NO: 137611 - RNA, 20 nt, Artificial Sequence
  mmSKRIPTE0008390_Elf1_1
  gRNA
aggaguugucauccgcgucg

SEQ ID NO: 137612 - RNA, 20 nt, Artificial Sequence
  mmSKRIPTE0008391_Elf1_2
  gRNA
gaagugaucacagugcccgg

SEQ ID NO: 137613 - RNA, 20 nt, Artificial Sequence
  mmSKRIPTE0008392_Elf1_3
  gRNA
cuguuugacggcuaccugag

SEQ ID NO: 137614 - RNA, 20 nt, Artificial Sequence
  mmSKRIPTE0008393_Elf1_4
  gRNA
uugagucgauuaaacagccg

SEQ ID NO: 137615 - RNA, 20 nt, Artificial Sequence
  mmSKRIPTE0008394_Elf1_5
  gRNA
gauauuugguguagucgucg

SEQ ID NO: 137616 - RNA, 20 nt, Artificial Sequence
  mmSKRIPTE0008395_Elf1_6
  gRNA
cuggcuauaaccguugugag

SEQ ID NO: 137617 - RNA, 20 nt, Artificial Sequence
  mmSKRIPTE0008396_Elf1_7
  gRNA
cgucgcgcugaacgauggug

SEQ ID NO: 137618 - RNA, 20 nt, Artificial Sequence
  mmSKRIPTE0008397_Elf1_8
  gRNA
uaaccagagcucauggccgu

SEQ ID NO: 137619 - RNA, 20 nt, Artificial Sequence
  mmSKRIPTE0008398_Elf1_9
  gRNA
cuauagguuuaacauaccga

SEQ ID NO: 137620 - RNA, 20 nt, Artificial Sequence
  mmSKRIPTE0008399_H2-M10.6_1
  gRNA
ugaagcccuacuuaucagag

SEQ ID NO: 137621 - RNA, 20 nt, Artificial Sequence
  mmSKRIPTE0008400_H2-M10.6_2
  gRNA
guagugauuuagaccugaug

SEQ ID NO: 137622 - RNA, 20 nt, Artificial Sequence
  mmSKRIPTE0008401_H2-M10.6_3
  gRNA
ucuccaucccuucuaucaag

SEQ ID NO: 137623 - RNA, 20 nt, Artificial Sequence
  mmSKRIPTE0008402_H2-M10.6_4
  gRNA
gcugcaacguggcaaaugau

SEQ ID NO: 137624 - RNA, 20 nt, Artificial Sequence
  mmSKRIPTE0008403_H2-M10.6_5
  gRNA
uggagucuacguauccgacc

SEQ ID NO: 137625 - RNA, 20 nt, Artificial Sequence
  mmSKRIPTE0008404_H2-M10.6_6
  gRNA
uuaccugcuaggggaaugcg

SEQ ID NO: 137626 - RNA, 20 nt, Artificial Sequence
  mmSKRIPTE0008405_H2-M10.6_7
  gRNA
gaccaagcuacaaaaguacc

SEQ ID NO: 137627 - RNA, 20 nt, Artificial Sequence
  mmSKRIPTE0008406_H2-M10.6_8
  gRNA
uucagucuagcaagucacac

SEQ ID NO: 137628 - RNA, 20 nt, Artificial Sequence
  mmSKRIPTE0008407_H2-M10.6_9
  gRNA
ugagccgguagugaccuucg

SEQ ID NO: 137629 - RNA, 20 nt, Artificial Sequence
  mmSKRIPTE0008408_Flt3l_1
  gRNA
caaaugugcguauaccugag

SEQ ID NO: 137630 - RNA, 20 nt, Artificial Sequence
  mmSKRIPTE0008409_Flt3l_2
  gRNA
cagauccccaggugaccucg

SEQ ID NO: 137631 - RNA, 20 nt, Artificial Sequence
  mmSKRIPTE0008410_Flt3l_3
  gRNA
ucugaagcccuguaucggga

SEQ ID NO: 137632 - RNA, 20 nt, Artificial Sequence
  mmSKRIPTE0008411_Flt3l_4
  gRNA
uccuaacaacuggagaaccc

SEQ ID NO: 137633 - RNA, 20 nt, Artificial Sequence
  mmSKRIPTE0008412_Flt3l_5
  gRNA
cucccccuaaaagacccggc

SEQ ID NO: 137634 - RNA, 20 nt, Artificial Sequence
  mmSKRIPTE0008413_Flt3l_6
  gRNA
uuucccacagcauaccacgg

SEQ ID NO: 137635 - RNA, 20 nt, Artificial Sequence
  mmSKRIPTE0008414_Flt3l_7
  gRNA
gcuaaccuggaagguacaug

SEQ ID NO: 137636 - RNA, 20 nt, Artificial Sequence
  mmSKRIPTE0008415_Flt3l_8
  gRNA
cugcugaguccuugccugcg

SEQ ID NO: 137637 - RNA, 20 nt, Artificial Sequence
  mmSKRIPTE0008416_Flt3l_9
  gRNA
gcuggaaccuccaagccccg

SEQ ID NO: 137638 - RNA, 20 nt, Artificial Sequence
  mmSKRIPTE0008417_Tdgf1_1
  gRNA
gaucuccguguagaccggca

SEQ ID NO: 137639 - RNA, 20 nt, Artificial Sequence
  mmSKRIPTE0008418_Tdgf1_2
  gRNA
guaagaguuuauuccgagcg

SEQ ID NO: 137640 - RNA, 20 nt, Artificial Sequence
  mmSKRIPTE0008419_Tdgf1_3
  gRNA
aagcagcaauguuacugaca

SEQ ID NO: 137641 - RNA, 20 nt, Artificial Sequence
  mmSKRIPTE0008420_Tdgf1_4
  gRNA
aggucuuuccgaguacucug

SEQ ID NO: 137642 - RNA, 20 nt, Artificial Sequence
  mmSKRIPTE0008421_Tdgf1_5
  gRNA
uuugugauugaggacuucgg

SEQ ID NO: 137643 - RNA, 20 nt, Artificial Sequence
  mmSKRIPTE0008422_Tdgf1_6
  gRNA
ccauccaccaccaaguaggg

SEQ ID NO: 137644 - RNA, 20 nt, Artificial Sequence
  mmSKRIPTE0008423_Tdgf1_7
  gRNA
ggcuauguuuaacgacccag

SEQ ID NO: 137645 - RNA, 20 nt, Artificial Sequence
  mmSKRIPTE0008424_Tdgf1_8
  gRNA
uguuacuggagacagcgcgg

SEQ ID NO: 137646 - RNA, 20 nt, Artificial Sequence
  mmSKRIPTE0008425_Tdgf1_9
  gRNA
cggcguuugacacggagucc

SEQ ID NO: 137647 - RNA, 20 nt, Artificial Sequence
  mmSKRIPTE0008426_Mlh1_1
  gRNA
cgguaugucaguaaucacac

SEQ ID NO: 137648 - RNA, 20 nt, Artificial Sequence
  mmSKRIPTE0008427_Mlh1_2
  gRNA
cuugacugcagguucucgaa

SEQ ID NO: 137649 - RNA, 20 nt, Artificial Sequence
  mmSKRIPTE0008428_Mlh1_3
  gRNA
aggagguccucucuaugcaa

SEQ ID NO: 137650 - RNA, 20 nt, Artificial Sequence
  mmSKRIPTE0008429_Mlh1_4
  gRNA
agggcacccugaucacggug

SEQ ID NO: 137651 - RNA, 20 nt, Artificial Sequence
  mmSKRIPTE0008430_Mlh1_5
  gRNA
cucugucccgcucuaaacag

SEQ ID NO: 137652 - RNA, 20 nt, Artificial Sequence
  mmSKRIPTE0008431_Mlh1_6
  gRNA
uggaaaaggccgaaucacca

SEQ ID NO: 137653 - RNA, 20 nt, Artificial Sequence
  mmSKRIPTE0008432_Mlh1_7
  gRNA
gacgguagugaaccgcauag

SEQ ID NO: 137654 - RNA, 20 nt, Artificial Sequence
  mmSKRIPTE0008433_Mlh1_8
  gRNA
cacuaguggaaguggcgaca

SEQ ID NO: 137655 - RNA, 20 nt, Artificial Sequence
  mmSKRIPTE0008434_Mlh1_9
  gRNA
auguagcaucagaucugucg

SEQ ID NO: 137656 - RNA, 20 nt, Artificial Sequence
  mmSKRIPTE0008435_Crp_1
  gRNA
gugcggaaaagucugcacaa

SEQ ID NO: 137657 - RNA, 20 nt, Artificial Sequence
  mmSKRIPTE0008436_Crp_2
  gRNA
aauuccgugcucuagugcug

SEQ ID NO: 137658 - RNA, 20 nt, Artificial Sequence
  mmSKRIPTE0008437_Crp_3
  gRNA
uguuuauuaagccgcagcug

SEQ ID NO: 137659 - RNA, 20 nt, Artificial Sequence
  mmSKRIPTE0008438_Crp_4
  gRNA
cccgccaguucaaaacauug

SEQ ID NO: 137660 - RNA, 20 nt, Artificial Sequence
  mmSKRIPTE0008439_Crp_5
  gRNA
uccagcauaagcaucccacu

SEQ ID NO: 137661 - RNA, 20 nt, Artificial Sequence
  mmSKRIPTE0008440_Crp_6
  gRNA
aagguucauaacccgagaca

SEQ ID NO: 137662 - RNA, 20 nt, Artificial Sequence
  mmSKRIPTE0008441_Crp_7
  gRNA
ccagcugggagucugcuacg

SEQ ID NO: 137663 - RNA, 20 nt, Artificial Sequence
  mmSKRIPTE0008442_Crp_8
  gRNA
cagaugcaagcaucaucuug

SEQ ID NO: 137664 - RNA, 20 nt, Artificial Sequence
  mmSKRIPTE0008443_Crp_9
  gRNA
ggucugacguuuaccccaag

SEQ ID NO: 137665 - RNA, 20 nt, Artificial Sequence
  mmSKRIPTE0008444_Stk11_1
  gRNA
guacgagcgccucagccaga

SEQ ID NO: 137666 - RNA, 20 nt, Artificial Sequence
  mmSKRIPTE0008445_Stk11_2
  gRNA
gaccucgguguugccgaggu

SEQ ID NO: 137667 - RNA, 20 nt, Artificial Sequence
  mmSKRIPTE0008446_Stk11_3
  gRNA
uggaguaugagccggccaag

SEQ ID NO: 137668 - RNA, 20 nt, Artificial Sequence
  mmSKRIPTE0008447_Stk11_4
  gRNA
gugcugccuaaucugucgga

SEQ ID NO: 137669 - RNA, 20 nt, Artificial Sequence
  mmSKRIPTE0008448_Stk11_5
  gRNA
gugauguuguaacuucacau

SEQ ID NO: 137670 - RNA, 20 nt, Artificial Sequence
  mmSKRIPTE0008449_Stk11_6
  gRNA
gcgcuguggcugucaucagu

SEQ ID NO: 137671 - RNA, 20 nt, Artificial Sequence
  mmSKRIPTE0008450_Stk11_7
  gRNA
ugggccacuaaaauuacaca

SEQ ID NO: 137672 - RNA, 20 nt, Artificial Sequence
  mmSKRIPTE0008451_Stk11_8
  gRNA
gguggucuguuggcccagcg

SEQ ID NO: 137673 - RNA, 20 nt, Artificial Sequence
  mmSKRIPTE0008452_Stk11_9
  gRNA
uaaucuaugcugacuccaug

SEQ ID NO: 137674 - RNA, 20 nt, Artificial Sequence
  mmSKRIPTE0008453_Il23a_1
  gRNA
ucauucagugaacucgacac

SEQ ID NO: 137675 - RNA, 20 nt, Artificial Sequence
  mmSKRIPTE0008454_Il23a_2
  gRNA
ugcuugcaaaggauccgcca

SEQ ID NO: 137676 - RNA, 20 nt, Artificial Sequence
  mmSKRIPTE0008455_Il23a_3
  gRNA
aggugugaaguugcuccaug

SEQ ID NO: 137677 - RNA, 20 nt, Artificial Sequence
  mmSKRIPTE0008456_Il23a_4
  gRNA
uguccuaucucauuccacga

SEQ ID NO: 137678 - RNA, 20 nt, Artificial Sequence
  mmSKRIPTE0008457_Il23a_5
  gRNA
ucaggaagccgcuuagaagu

SEQ ID NO: 137679 - RNA, 20 nt, Artificial Sequence
  mmSKRIPTE0008458_Il23a_6
  gRNA
uagcuuugucugagaugacg

SEQ ID NO: 137680 - RNA, 20 nt, Artificial Sequence
  mmSKRIPTE0008459_Il23a_7
  gRNA
cuggaacgcacaugcaccag

SEQ ID NO: 137681 - RNA, 20 nt, Artificial Sequence
  mmSKRIPTE0008460_Il23a_8
  gRNA
gcaucuguugggucucccgg

SEQ ID NO: 137682 - RNA, 20 nt, Artificial Sequence
  mmSKRIPTE0008461_Il23a_9
  gRNA
ccaucuucacacuggauacg

SEQ ID NO: 137683 - RNA, 20 nt, Artificial Sequence
  mmSKRIPTE0008462_Vtn_1
  gRNA
agcuagaugagacggcagug

SEQ ID NO: 137684 - RNA, 20 nt, Artificial Sequence
  mmSKRIPTE0008463_Vtn_2
  gRNA
ggacguguucacuaugccag

SEQ ID NO: 137685 - RNA, 20 nt, Artificial Sequence
  mmSKRIPTE0008464_Vtn_3
  gRNA
uaacacgcuuagcuuagcug

SEQ ID NO: 137686 - RNA, 20 nt, Artificial Sequence
  mmSKRIPTE0008465_Vtn_4
  gRNA
caaccuuagaacccggcgag

SEQ ID NO: 137687 - RNA, 20 nt, Artificial Sequence
  mmSKRIPTE0008466_Vtn_5
  gRNA
gccagugacguagaugcggc

SEQ ID NO: 137688 - RNA, 20 nt, Artificial Sequence
  mmSKRIPTE0008467_Vtn_6
  gRNA
cggugaccuaaauccucgga

SEQ ID NO: 137689 - RNA, 20 nt, Artificial Sequence
  mmSKRIPTE0008468_Vtn_7
  gRNA
gaagggugaggacauaccgc

SEQ ID NO: 137690 - RNA, 20 nt, Artificial Sequence
  mmSKRIPTE0008469_Vtn_8
  gRNA
aagccuucggagauguuucg

SEQ ID NO: 137691 - RNA, 20 nt, Artificial Sequence
  mmSKRIPTE0008470_Vtn_9
  gRNA
uugcuccacuuuaggcgcug

SEQ ID NO: 137692 - RNA, 20 nt, Artificial Sequence
  mmSKRIPTE0008471_Ccl7_1
  gRNA
ucucagaaagaacagcggug

SEQ ID NO: 137693 - RNA, 20 nt, Artificial Sequence
  mmSKRIPTE0008472_Ccl7_2
  gRNA
cauaauguuaugauacugug

SEQ ID NO: 137694 - RNA, 20 nt, Artificial Sequence
  mmSKRIPTE0008473_Ccl7_3
  gRNA
uuauaggcagccgauaggga

SEQ ID NO: 137695 - RNA, 20 nt, Artificial Sequence
  mmSKRIPTE0008474_Ccl7_4
  gRNA
ucaccccugaagcaguacau

SEQ ID NO: 137696 - RNA, 20 nt, Artificial Sequence
  mmSKRIPTE0008475_Ccl7_5
  gRNA
ugggucaugucaucaacuug

SEQ ID NO: 137697 - RNA, 20 nt, Artificial Sequence
  mmSKRIPTE0008476_Ccl7_6
  gRNA
ucacaggagaguguaaugug

SEQ ID NO: 137698 - RNA, 20 nt, Artificial Sequence
  mmSKRIPTE0008477_Ccl7_7
  gRNA
gggccagacaugguaacccu

SEQ ID NO: 137699 - RNA, 20 nt, Artificial Sequence
  mmSKRIPTE0008478_Ccl7_8
  gRNA
aaauggucacgccuaaggaa

SEQ ID NO: 137700 - RNA, 20 nt, Artificial Sequence
  mmSKRIPTE0008479_Ccl7_9
  gRNA
cacaacguuaaagugacaug

SEQ ID NO: 137701 - RNA, 20 nt, Artificial Sequence
  mmSKRIPTE0008480_Ccl11_1
  gRNA
ggacgaguuaggaguaacug

SEQ ID NO: 137702 - RNA, 20 nt, Artificial Sequence
  mmSKRIPTE0008481_Ccl11_2
  gRNA
ccccaggauaauuugcuaug

SEQ ID NO: 137703 - RNA, 20 nt, Artificial Sequence
  mmSKRIPTE0008482_Ccl11_3
  gRNA
ugcgacugaucauugugcag

SEQ ID NO: 137704 - RNA, 20 nt, Artificial Sequence
  mmSKRIPTE0008483_Ccl11_4
  gRNA
cagcaggaauagaagcgcug

SEQ ID NO: 137705 - RNA, 20 nt, Artificial Sequence
  mmSKRIPTE0008484_Ccl11_5
  gRNA
cucuggguuagugucaagag

SEQ ID NO: 137706 - RNA, 20 nt, Artificial Sequence
  mmSKRIPTE0008485_Ccl11_6
  gRNA
auaucagcaccagucgccca

SEQ ID NO: 137707 - RNA, 20 nt, Artificial Sequence
  mmSKRIPTE0008486_Ccl11_7
  gRNA
acaguacaaaggccaucaug

SEQ ID NO: 137708 - RNA, 20 nt, Artificial Sequence
  mmSKRIPTE0008487_Ccl11_8
  gRNA
uuuccuaagacgugcucuga

SEQ ID NO: 137709 - RNA, 20 nt, Artificial Sequence
  mmSKRIPTE0008488_Ccl11_9
  gRNA
ccacggucuucagcacagua

SEQ ID NO: 137710 - RNA, 20 nt, Artificial Sequence
  mmSKRIPTE0008489_Ngfr_1
  gRNA
ucucuggaugcgucgcaggg

SEQ ID NO: 137711 - RNA, 20 nt, Artificial Sequence
  mmSKRIPTE0008490_Ngfr_2
  gRNA
uauaaagguuaaggguuucg

SEQ ID NO: 137712 - RNA, 20 nt, Artificial Sequence
  mmSKRIPTE0008491_Ngfr_3
  gRNA
auuaacugugucagaucuag

SEQ ID NO: 137713 - RNA, 20 nt, Artificial Sequence
  mmSKRIPTE0008492_Ngfr_4
  gRNA
ggacagugagucucuuaggg

SEQ ID NO: 137714 - RNA, 20 nt, Artificial Sequence
  mmSKRIPTE0008493_Ngfr_5
  gRNA
cacaggccauuggagaccga

SEQ ID NO: 137715 - RNA, 20 nt, Artificial Sequence
  mmSKRIPTE0008494_Ngfr_6
  gRNA
gugacgucagagcccuccgg

SEQ ID NO: 137716 - RNA, 20 nt, Artificial Sequence
  mmSKRIPTE0008495_Ngfr_7
  gRNA
uaggcccuuacgaccuccag

SEQ ID NO: 137717 - RNA, 20 nt, Artificial Sequence
  mmSKRIPTE0008496_Ngfr_8
  gRNA
ggagucgggcuaauguccug

SEQ ID NO: 137718 - RNA, 20 nt, Artificial Sequence
  mmSKRIPTE0008497_Ngfr_9
  gRNA
ggggcuagaacaucagcggu

SEQ ID NO: 137719 - RNA, 20 nt, Artificial Sequence
  mmSKRIPTE0008498_Rnf31_1
  gRNA
gaagaugugaaacaccgcgg

SEQ ID NO: 137720 - RNA, 20 nt, Artificial Sequence
  mmSKRIPTE0008499_Rnf31_2
  gRNA
agguuccguagcauuauggg

SEQ ID NO: 137721 - RNA, 20 nt, Artificial Sequence
  mmSKRIPTE0008500_Rnf31_3
  gRNA
ccaccgugcugcgaaagacg

SEQ ID NO: 137722 - RNA, 20 nt, Artificial Sequence
  mmSKRIPTE0008501_Rnf31_4
  gRNA
gaaacagggcauaugcaucg

SEQ ID NO: 137723 - RNA, 20 nt, Artificial Sequence
  mmSKRIPTE0008502_Rnf31_5
  gRNA
aggguguugagguaguuucg

SEQ ID NO: 137724 - RNA, 20 nt, Artificial Sequence
  mmSKRIPTE0008503_Rnf31_6
  gRNA
auccuacugacugcguaacg

SEQ ID NO: 137725 - RNA, 20 nt, Artificial Sequence
  mmSKRIPTE0008504_Rnf31_7
  gRNA
cuuggaccuuaucggagaag

SEQ ID NO: 137726 - RNA, 20 nt, Artificial Sequence
  mmSKRIPTE0008505_Rnf31_8
  gRNA
cagaggcuuacccgguugcg

SEQ ID NO: 137727 - RNA, 20 nt, Artificial Sequence
  mmSKRIPTE0008506_Rnf31_9
  gRNA
cugcuccucccacugcaaag

SEQ ID NO: 137728 - RNA, 20 nt, Artificial Sequence
  mmSKRIPTE0008507_Retnlg_1
  gRNA
ugagaugcuuuaauacaccg

SEQ ID NO: 137729 - RNA, 20 nt, Artificial Sequence
  mmSKRIPTE0008508_Retnlg_2
  gRNA
ggaacuauagcucagguccg

SEQ ID NO: 137730 - RNA, 20 nt, Artificial Sequence
  mmSKRIPTE0008509_Retnlg_3
  gRNA
aaggaacuucuugccaaucg

SEQ ID NO: 137731 - RNA, 20 nt, Artificial Sequence
  mmSKRIPTE0008510_Retnlg_4
  gRNA
ggggaccuuagaaucuauug

SEQ ID NO: 137732 - RNA, 20 nt, Artificial Sequence
  mmSKRIPTE0008511_Retnlg_5
  gRNA
ggaucuugggauauccggga

SEQ ID NO: 137733 - RNA, 20 nt, Artificial Sequence
  mmSKRIPTE0008512_Retnlg_6
  gRNA
caguucggcugguuagagug

SEQ ID NO: 137734 - RNA, 20 nt, Artificial Sequence
  mmSKRIPTE0008513_Retnlg_7
  gRNA
gacaaccuuaagauacaaga

SEQ ID NO: 137735 - RNA, 20 nt, Artificial Sequence
  mmSKRIPTE0008514_Retnlg_8
  gRNA
gcugucaugugguggcauga

SEQ ID NO: 137736 - RNA, 20 nt, Artificial Sequence
  mmSKRIPTE0008515_Retnlg_9
  gRNA
ccauuguugagcacugacag

SEQ ID NO: 137737 - RNA, 20 nt, Artificial Sequence
  mmSKRIPTE0008516_H2-K1_1
  gRNA
ggugaaccguccuaguguag

SEQ ID NO: 137738 - RNA, 20 nt, Artificial Sequence
  mmSKRIPTE0008517_H2-K1_2
  gRNA
uagccgacuuccauguaccg

SEQ ID NO: 137739 - RNA, 20 nt, Artificial Sequence
  mmSKRIPTE0008518_H2-K1_3
  gRNA
cgaaucgccgacaggugcga

SEQ ID NO: 137740 - RNA, 20 nt, Artificial Sequence
  mmSKRIPTE0008519_H2-K1_4
  gRNA
ggucagcaaggugacuacaa

SEQ ID NO: 137741 - RNA, 20 nt, Artificial Sequence
  mmSKRIPTE0008520_H2-K1_5
  gRNA
gugaucgcgccacccaaugg

SEQ ID NO: 137742 - RNA, 20 nt, Artificial Sequence
  mmSKRIPTE0008521_H2-K1_6
  gRNA
gcugaucaccaaacacaagu

SEQ ID NO: 137743 - RNA, 20 nt, Artificial Sequence
  mmSKRIPTE0008522_H2-K1_7
  gRNA
agaaccaaucagugucgccg

SEQ ID NO: 137744 - RNA, 20 nt, Artificial Sequence
  mmSKRIPTE0008523_H2-K1_8
  gRNA
cagcucuuacccccauuggg

SEQ ID NO: 137745 - RNA, 20 nt, Artificial Sequence
  mmSKRIPTE0008524_H2-K1_9
  gRNA
gagacucagggccuaccugg

SEQ ID NO: 137746 - RNA, 20 nt, Artificial Sequence
  mmSKRIPTE0008525_H2-M3_1
  gRNA
auccgcuggaauacugcaca

SEQ ID NO: 137747 - RNA, 20 nt, Artificial Sequence
  mmSKRIPTE0008526_H2-M3_2
  gRNA
ccaaaggugauguuaccuug

SEQ ID NO: 137748 - RNA, 20 nt, Artificial Sequence
  mmSKRIPTE0008527_H2-M3_3
  gRNA
ugucuacccagugaacaggc

SEQ ID NO: 137749 - RNA, 20 nt, Artificial Sequence
  mmSKRIPTE0008528_H2-M3_4
  gRNA
agaguacuucagggccuaug

SEQ ID NO: 137750 - RNA, 20 nt, Artificial Sequence
  mmSKRIPTE0008529_H2-M3_5
  gRNA
cuauuguuguggugugcaag

SEQ ID NO: 137751 - RNA, 20 nt, Artificial Sequence
  mmSKRIPTE0008530_H2-M3_6
  gRNA
guccaaauccuguuggcggg

SEQ ID NO: 137752 - RNA, 20 nt, Artificial Sequence
  mmSKRIPTE0008531_H2-M3_7
  gRNA
uuuccuccucugaagaucaa

SEQ ID NO: 137753 - RNA, 20 nt, Artificial Sequence
  mmSKRIPTE0008532_H2-M3_8
  gRNA
gcaucgggaccaggugcucg

SEQ ID NO: 137754 - RNA, 20 nt, Artificial Sequence
  mmSKRIPTE0008533_H2-M3_9
  gRNA
cagacugccaguaaguaugg

SEQ ID NO: 137755 - RNA, 20 nt, Artificial Sequence
  mmSKRIPTE0008534_S100a8_1
  gRNA
acugaaaggaaaagucgcag

SEQ ID NO: 137756 - RNA, 20 nt, Artificial Sequence
  mmSKRIPTE0008535_S100a8_2
  gRNA
gagcugacaaaggauaugug

SEQ ID NO: 137757 - RNA, 20 nt, Artificial Sequence
  mmSKRIPTE0008536_S100a8_3
  gRNA
aguguaggcucuccuuagcg

SEQ ID NO: 137758 - RNA, 20 nt, Artificial Sequence
  mmSKRIPTE0008537_S100a8_4
  gRNA
aaguaagcgaggacuaucug

SEQ ID NO: 137759 - RNA, 20 nt, Artificial Sequence
  mmSKRIPTE0008538_S100a8_5
  gRNA
agcguugucuccauagcccg

SEQ ID NO: 137760 - RNA, 20 nt, Artificial Sequence
  mmSKRIPTE0008539_S100a8_6
  gRNA
uuaucugagugguacaggcc

SEQ ID NO: 137761 - RNA, 20 nt, Artificial Sequence
  mmSKRIPTE0008540_S100a8_7
  gRNA
agcugcaguuacucacggca

SEQ ID NO: 137762 - RNA, 20 nt, Artificial Sequence
  mmSKRIPTE0008541_S100a8_8
  gRNA
cagcaccgaucaaaugcuug

SEQ ID NO: 137763 - RNA, 20 nt, Artificial Sequence
  mmSKRIPTE0008542_S100a8_9
  gRNA
aaaauggcucuaucucugau

SEQ ID NO: 137764 - RNA, 20 nt, Artificial Sequence
  mmSKRIPTE0008543_Rorc_1
  gRNA
aauuauacaguggagguucg

SEQ ID NO: 137765 - RNA, 20 nt, Artificial Sequence
  mmSKRIPTE0008544_Rorc_2
  gRNA
gucaucugggauccacuacg

SEQ ID NO: 137766 - RNA, 20 nt, Artificial Sequence
  mmSKRIPTE0008545_Rorc_3
  gRNA
cucugcaagacucaucgaca

SEQ ID NO: 137767 - RNA, 20 nt, Artificial Sequence
  mmSKRIPTE0008546_Rorc_4
  gRNA
cugauguugaauccccugag

SEQ ID NO: 137768 - RNA, 20 nt, Artificial Sequence
  mmSKRIPTE0008547_Rorc_5
  gRNA
uguccccacagaucuugcaa

SEQ ID NO: 137769 - RNA, 20 nt, Artificial Sequence
  mmSKRIPTE0008548_Rorc_6
  gRNA
ugcggcugguucggucaaug

SEQ ID NO: 137770 - RNA, 20 nt, Artificial Sequence
  mmSKRIPTE0008549_Rorc_7
  gRNA
ggaccaccucaaacuccgag

SEQ ID NO: 137771 - RNA, 20 nt, Artificial Sequence
  mmSKRIPTE0008550_Rorc_8
  gRNA
gagguuagaauaucuuagug

SEQ ID NO: 137772 - RNA, 20 nt, Artificial Sequence
  mmSKRIPTE0008551_Rorc_9
  gRNA
ccauugccaauccaaagcag

SEQ ID NO: 137773 - RNA, 20 nt, Artificial Sequence
  mmSKRIPTE0008552_Cmklr1_1
  gRNA
agacuggauucgaaucgcag

SEQ ID NO: 137774 - RNA, 20 nt, Artificial Sequence
  mmSKRIPTE0008553_Cmklr1_2
  gRNA
caucugucaucucacacgug

SEQ ID NO: 137775 - RNA, 20 nt, Artificial Sequence
  mmSKRIPTE0008554_Cmklr1_3
  gRNA
ccacgugugccagcuagggu

SEQ ID NO: 137776 - RNA, 20 nt, Artificial Sequence
  mmSKRIPTE0008555_Cmklr1_4
  gRNA
uuuggauuucagaagaacgg

SEQ ID NO: 137777 - RNA, 20 nt, Artificial Sequence
  mmSKRIPTE0008556_Cmklr1_5
  gRNA
acucgcaaguaguuuccaca

SEQ ID NO: 137778 - RNA, 20 nt, Artificial Sequence
  mmSKRIPTE0008557_Cmklr1_6
  gRNA
ugcguguagauguucgcgca

SEQ ID NO: 137779 - RNA, 20 nt, Artificial Sequence
  mmSKRIPTE0008558_Cmklr1_7
  gRNA
gauaggggauauaagcgagu

SEQ ID NO: 137780 - RNA, 20 nt, Artificial Sequence
  mmSKRIPTE0008559_Cmklr1_8
  gRNA
uaaucacaagggucuuauca

SEQ ID NO: 137781 - RNA, 20 nt, Artificial Sequence
  mmSKRIPTE0008560_Cmklr1_9
  gRNA
cauccucgugggcaucccga

SEQ ID NO: 137782 - RNA, 20 nt, Artificial Sequence
  mmSKRIPTE0008561_Vegfc_1
  gRNA
gguuaccucagcaagacggu

SEQ ID NO: 137783 - RNA, 20 nt, Artificial Sequence
  mmSKRIPTE0008562_Vegfc_2
  gRNA
agcccuuugagugaucgggg

SEQ ID NO: 137784 - RNA, 20 nt, Artificial Sequence
  mmSKRIPTE0008563_Vegfc_3
  gRNA
ucaauaccugucgagucaca

SEQ ID NO: 137785 - RNA, 20 nt, Artificial Sequence
  mmSKRIPTE0008564_Vegfc_4
  gRNA
auccucagcccgacccgacg

SEQ ID NO: 137786 - RNA, 20 nt, Artificial Sequence
  mmSKRIPTE0008565_Vegfc_5
  gRNA
acaucuauacacaccucacg

SEQ ID NO: 137787 - RNA, 20 nt, Artificial Sequence
  mmSKRIPTE0008566_Vegfc_6
  gRNA
gguguacagagaaccugccg

SEQ ID NO: 137788 - RNA, 20 nt, Artificial Sequence
  mmSKRIPTE0008567_Vegfc_7
  gRNA
caugaaugacaauaccagug

SEQ ID NO: 137789 - RNA, 20 nt, Artificial Sequence
  mmSKRIPTE0008568_Vegfc_8
  gRNA
gacuuaauucauacucacug

SEQ ID NO: 137790 - RNA, 20 nt, Artificial Sequence
  mmSKRIPTE0008569_Vegfc_9
  gRNA
caucuguagacggacacaca

SEQ ID NO: 137791 - RNA, 20 nt, Artificial Sequence
  mmSKRIPTE0008570_Nck1_1
  gRNA
cccguggaacaaguaacuca

SEQ ID NO: 137792 - RNA, 20 nt, Artificial Sequence
  mmSKRIPTE0008571_Nck1_2
  gRNA
uacaugaccaguuaaagcug

SEQ ID NO: 137793 - RNA, 20 nt, Artificial Sequence
  mmSKRIPTE0008572_Nck1_3
  gRNA
agggaccaaggugaucguca

SEQ ID NO: 137794 - RNA, 20 nt, Artificial Sequence
  mmSKRIPTE0008573_Nck1_4
  gRNA
cuuacucaaaacaggcacgc

SEQ ID NO: 137795 - RNA, 20 nt, Artificial Sequence
  mmSKRIPTE0008574_Nck1_5
  gRNA
ccgaucuuuacaagugagca

SEQ ID NO: 137796 - RNA, 20 nt, Artificial Sequence
  mmSKRIPTE0008575_Nck1_6
  gRNA
ggcuuccuuaagccaaacug

SEQ ID NO: 137797 - RNA, 20 nt, Artificial Sequence
  mmSKRIPTE0008576_Nck1_7
  gRNA
cccgugaaaggggguacuug

SEQ ID NO: 137798 - RNA, 20 nt, Artificial Sequence
  mmSKRIPTE0008577_Nck1_8
  gRNA
caguaucacuaaaagcacaa

SEQ ID NO: 137799 - RNA, 20 nt, Artificial Sequence
  mmSKRIPTE0008578_Nck1_9
  gRNA
gcuacaacggacaaauugga

SEQ ID NO: 137800 - RNA, 20 nt, Artificial Sequence
  mmSKRIPTE0008579_Eif2ak4_1
  gRNA
agauagacgugcugagccgu

SEQ ID NO: 137801 - RNA, 20 nt, Artificial Sequence
  mmSKRIPTE0008580_Eif2ak4_2
  gRNA
uggaguucaucgcaaaguag

SEQ ID NO: 137802 - RNA, 20 nt, Artificial Sequence
  mmSKRIPTE0008581_Eif2ak4_3
  gRNA
gcugucaucaagguacgaca

SEQ ID NO: 137803 - RNA, 20 nt, Artificial Sequence
  mmSKRIPTE0008582_Eif2ak4_4
  gRNA
uguguucacggaacaccgug

SEQ ID NO: 137804 - RNA, 20 nt, Artificial Sequence
  mmSKRIPTE0008583_Eif2ak4_5
  gRNA
acuacaacgccuggaucgag

SEQ ID NO: 137805 - RNA, 20 nt, Artificial Sequence
  mmSKRIPTE0008584_Eif2ak4_6
  gRNA
accgucacauauuugcugug

SEQ ID NO: 137806 - RNA, 20 nt, Artificial Sequence
  mmSKRIPTE0008585_Eif2ak4_7
  gRNA
aagcucgagcacucuacaug

SEQ ID NO: 137807 - RNA, 20 nt, Artificial Sequence
  mmSKRIPTE0008586_Eif2ak4_8
  gRNA
aaaaggugcaaugugcacca

SEQ ID NO: 137808 - RNA, 20 nt, Artificial Sequence
  mmSKRIPTE0008587_Eif2ak4_9
  gRNA
ugaagugcugcaccacacgc

SEQ ID NO: 137809 - RNA, 20 nt, Artificial Sequence
  mmSKRIPTE0008588_Apoa2_1
  gRNA
agcacagaaucgguaugcug

SEQ ID NO: 137810 - RNA, 20 nt, Artificial Sequence
  mmSKRIPTE0008589_Apoa2_2
  gRNA
gguccccaaauaauauaccc

SEQ ID NO: 137811 - RNA, 20 nt, Artificial Sequence
  mmSKRIPTE0008590_Apoa2_3
  gRNA
ucuucucaaaguaugcccug

SEQ ID NO: 137812 - RNA, 20 nt, Artificial Sequence
  mmSKRIPTE0008591_Apoa2_4
  gRNA
gaucaggcuggaguaaacaa

SEQ ID NO: 137813 - RNA, 20 nt, Artificial Sequence
  mmSKRIPTE0008592_Apoa2_5
  gRNA
auucuccguaucaccugacg

SEQ ID NO: 137814 - RNA, 20 nt, Artificial Sequence
  mmSKRIPTE0008593_Apoa2_6
  gRNA
caagcccagaguagacggga

SEQ ID NO: 137815 - RNA, 20 nt, Artificial Sequence
  mmSKRIPTE0008594_Apoa2_7
  gRNA
cagcaguuuaaugaaccuug

SEQ ID NO: 137816 - RNA, 20 nt, Artificial Sequence
  mmSKRIPTE0008595_Apoa2_8
  gRNA
aggggcauaaacucuaguga

SEQ ID NO: 137817 - RNA, 20 nt, Artificial Sequence
  mmSKRIPTE0008596_Apoa2_9
  gRNA
agguugagugcaucaaccag

SEQ ID NO: 137818 - RNA, 20 nt, Artificial Sequence
  mmSKRIPTE0008597_Trp53_1
  gRNA
uuuagccagggugagcacgu

SEQ ID NO: 137819 - RNA, 20 nt, Artificial Sequence
  mmSKRIPTE0008598_Trp53_2
  gRNA
gggugucuguaaauccugcg

SEQ ID NO: 137820 - RNA, 20 nt, Artificial Sequence
  mmSKRIPTE0008599_Trp53_3
  gRNA
uagguagcgacuacaguuag

SEQ ID NO: 137821 - RNA, 20 nt, Artificial Sequence
  mmSKRIPTE0008600_Trp53_4
  gRNA
gagggaacagacgcuuaaca

SEQ ID NO: 137822 - RNA, 20 nt, Artificial Sequence
  mmSKRIPTE0008601_Trp53_5
  gRNA
aaaggcaccgugagccgcug

SEQ ID NO: 137823 - RNA, 20 nt, Artificial Sequence
  mmSKRIPTE0008602_Trp53_6
  gRNA
agcccucaacaccgccugug

SEQ ID NO: 137824 - RNA, 20 nt, Artificial Sequence
  mmSKRIPTE0008603_Trp53_7
  gRNA
gugaaauacucuccaucaag

SEQ ID NO: 137825 - RNA, 20 nt, Artificial Sequence
  mmSKRIPTE0008604_Trp53_8
  gRNA
accaacuuacaccauaagac

SEQ ID NO: 137826 - RNA, 20 nt, Artificial Sequence
  mmSKRIPTE0008605_Trp53_9
  gRNA
uaaaacuagagaaaaccgug

SEQ ID NO: 137827 - RNA, 20 nt, Artificial Sequence
  mmSKRIPTE0008606_Tac4_1
  gRNA
uggacaaaccucucgugcca

SEQ ID NO: 137828 - RNA, 20 nt, Artificial Sequence
  mmSKRIPTE0008607_Tac4_2
  gRNA
cuccugugacaggugcacaa

SEQ ID NO: 137829 - RNA, 20 nt, Artificial Sequence
  mmSKRIPTE0008608_Tac4_3
  gRNA
agaaagccuccagagucgag

SEQ ID NO: 137830 - RNA, 20 nt, Artificial Sequence
  mmSKRIPTE0008609_Tac4_4
  gRNA
gggacggaauuaugcaaccc

SEQ ID NO: 137831 - RNA, 20 nt, Artificial Sequence
  mmSKRIPTE0008610_Tac4_5
  gRNA
agggcuauucaguagaugag

SEQ ID NO: 137832 - RNA, 20 nt, Artificial Sequence
  mmSKRIPTE0008611_Tac4_6
  gRNA
agucaacagagggcacgacc

SEQ ID NO: 137833 - RNA, 20 nt, Artificial Sequence
  mmSKRIPTE0008612_Tac4_7
  gRNA
uugaucuguccaacuaccag

SEQ ID NO: 137834 - RNA, 20 nt, Artificial Sequence
  mmSKRIPTE0008613_Tac4_8
  gRNA
cugggugaccgugaaccuga

SEQ ID NO: 137835 - RNA, 20 nt, Artificial Sequence
  mmSKRIPTE0008614_Tac4_9
  gRNA
cacauacaaguggccccgug

SEQ ID NO: 137836 - RNA, 20 nt, Artificial Sequence
  mmSKRIPTE0008615_Papd4_1
  gRNA
uaaagcaccugaaaaaagcg

SEQ ID NO: 137837 - RNA, 20 nt, Artificial Sequence
  mmSKRIPTE0008616_Papd4_2
  gRNA
uacuuauccugagaacuacg

SEQ ID NO: 137838 - RNA, 20 nt, Artificial Sequence
  mmSKRIPTE0008617_Papd4_3
  gRNA
caaccacuuacgguaugcau

SEQ ID NO: 137839 - RNA, 20 nt, Artificial Sequence
  mmSKRIPTE0008618_Papd4_4
  gRNA
ccggaagaucaacgugaccc

SEQ ID NO: 137840 - RNA, 20 nt, Artificial Sequence
  mmSKRIPTE0008619_Papd4_5
  gRNA
gcaaacgcgcucuccagugu

SEQ ID NO: 137841 - RNA, 20 nt, Artificial Sequence
  mmSKRIPTE0008620_Papd4_6
  gRNA
ucaccggcguccacgccgaa

SEQ ID NO: 137842 - RNA, 20 nt, Artificial Sequence
  mmSKRIPTE0008621_Papd4_7
  gRNA
gauaaaugguuacuagacag

SEQ ID NO: 137843 - RNA, 20 nt, Artificial Sequence
  mmSKRIPTE0008622_Papd4_8
  gRNA
cccuuguggucucauaccug

SEQ ID NO: 137844 - RNA, 20 nt, Artificial Sequence
  mmSKRIPTE0008623_Papd4_9
  gRNA
uaucaucuuuagcaucaaca

SEQ ID NO: 137845 - RNA, 20 nt, Artificial Sequence
  mmSKRIPTE0008624_Mbl1_1
  gRNA
ugucucaaccagaguuggcg

SEQ ID NO: 137846 - RNA, 20 nt, Artificial Sequence
  mmSKRIPTE0008625_Mbl1_2
  gRNA
gcucuuucguggagucacug

SEQ ID NO: 137847 - RNA, 20 nt, Artificial Sequence
  mmSKRIPTE0008626_Mbl1_3
  gRNA
cggauguacaccagucuggg

SEQ ID NO: 137848 - RNA, 20 nt, Artificial Sequence
  mmSKRIPTE0008627_Mbl1_4
  gRNA
cugaagguacaucccaacca

SEQ ID NO: 137849 - RNA, 20 nt, Artificial Sequence
  mmSKRIPTE0008628_Mbl1_5
  gRNA
cucuggcuuuacauccagug

SEQ ID NO: 137850 - RNA, 20 nt, Artificial Sequence
  mmSKRIPTE0008629_Mbl1_6
  gRNA
accacacuaggccagaaccu

SEQ ID NO: 137851 - RNA, 20 nt, Artificial Sequence
  mmSKRIPTE0008630_Mbl1_7
  gRNA
ucacggacgaggcgacugaa

SEQ ID NO: 137852 - RNA, 20 nt, Artificial Sequence
  mmSKRIPTE0008631_Mbl1_8
  gRNA
aucagggucacaaaccugug

SEQ ID NO: 137853 - RNA, 20 nt, Artificial Sequence
  mmSKRIPTE0008632_Mbl1_9
  gRNA
aguucauguacgugacaggg

SEQ ID NO: 137854 - RNA, 20 nt, Artificial Sequence
  mmSKRIPTE0008633_Lua_1
  gRNA
auccgggacuucaaggaccg

SEQ ID NO: 137855 - RNA, 20 nt, Artificial Sequence
  mmSKRIPTE0008634_Lua_2
  gRNA
gagacugauaaggccgccac

SEQ ID NO: 137856 - RNA, 20 nt, Artificial Sequence
  mmSKRIPTE0008635_Lua_3
  gRNA
uagucuaagcccuuagccug

SEQ ID NO: 137857 - RNA, 20 nt, Artificial Sequence
  mmSKRIPTE0008636_Lua_4
  gRNA
augguggauucacgggagug

SEQ ID NO: 137858 - RNA, 20 nt, Artificial Sequence
  mmSKRIPTE0008637_Lua_5
  gRNA
gugggccgcagggacuagca

SEQ ID NO: 137859 - RNA, 20 nt, Artificial Sequence
  mmSKRIPTE0008638_Lua_6
  gRNA
uggggggcuaucaagaucag

SEQ ID NO: 137860 - RNA, 20 nt, Artificial Sequence
  mmSKRIPTE0008639_Lua_7
  gRNA
gaucgugccuuucuccgaca

SEQ ID NO: 137861 - RNA, 20 nt, Artificial Sequence
  mmSKRIPTE0008640_Lua_8
  gRNA
gcgcucgggucccuuuauag

SEQ ID NO: 137862 - RNA, 20 nt, Artificial Sequence
  mmSKRIPTE0008641_Lua_9
  gRNA
aggggacuacaucuucccca

SEQ ID NO: 137863 - RNA, 20 nt, Artificial Sequence
  mmSKRIPTE0008642_Lime1_1
  gRNA
agacugcaugagcugcaccg

SEQ ID NO: 137864 - RNA, 20 nt, Artificial Sequence
  mmSKRIPTE0008643_Lime1_2
  gRNA
auccaugcuagcaggccgug

SEQ ID NO: 137865 - RNA, 20 nt, Artificial Sequence
  mmSKRIPTE0008644_Lime1_3
  gRNA
gggagaaggaacccacuagu

SEQ ID NO: 137866 - RNA, 20 nt, Artificial Sequence
  mmSKRIPTE0008645_Lime1_4
  gRNA
ucugccgcuugggagugaug

SEQ ID NO: 137867 - RNA, 20 nt, Artificial Sequence
  mmSKRIPTE0008646_Lime1_5
  gRNA
gaaucccaggcacauaccug

SEQ ID NO: 137868 - RNA, 20 nt, Artificial Sequence
  mmSKRIPTE0008647_Lime1_6
  gRNA
uacgaggccaucaaucucag

SEQ ID NO: 137869 - RNA, 20 nt, Artificial Sequence
  mmSKRIPTE0008648_Lime1_7
  gRNA
cuggacaucucuagccagcg

SEQ ID NO: 137870 - RNA, 20 nt, Artificial Sequence
  mmSKRIPTE0008649_Lime1_8
  gRNA
ugagugccagacugucccag

SEQ ID NO: 137871 - RNA, 20 nt, Artificial Sequence
  mmSKRIPTE0008650_Lime1_9
  gRNA
cgauagagaaguccauauga

SEQ ID NO: 137872 - RNA, 20 nt, Artificial Sequence
  mmSKRIPTE0008651_Tlr2_1
  gRNA
ucacuacgucugacuccgag

SEQ ID NO: 137873 - RNA, 20 nt, Artificial Sequence
  mmSKRIPTE0008652_Tlr2_2
  gRNA
gaaaguccagaggcuccgug

SEQ ID NO: 137874 - RNA, 20 nt, Artificial Sequence
  mmSKRIPTE0008653_Tlr2_3
  gRNA
agcuggcgucuccauaguaa

SEQ ID NO: 137875 - RNA, 20 nt, Artificial Sequence
  mmSKRIPTE0008654_Tlr2_4
  gRNA
ccggaacgaagucccgcuug

SEQ ID NO: 137876 - RNA, 20 nt, Artificial Sequence
  mmSKRIPTE0008655_Tlr2_5
  gRNA
agaugucguucaaggaggug

SEQ ID NO: 137877 - RNA, 20 nt, Artificial Sequence
  mmSKRIPTE0008656_Tlr2_6
  gRNA
guccaguacagggauccggg

SEQ ID NO: 137878 - RNA, 20 nt, Artificial Sequence
  mmSKRIPTE0008657_Tlr2_7
  gRNA
cuuugacgagaacaacgacg

SEQ ID NO: 137879 - RNA, 20 nt, Artificial Sequence
  mmSKRIPTE0008658_Tlr2_8
  gRNA
uagaaacagucacuauccgg

SEQ ID NO: 137880 - RNA, 20 nt, Artificial Sequence
  mmSKRIPTE0008659_Tlr2_9
  gRNA
augaagaagcuggcauuccg

SEQ ID NO: 137881 - RNA, 20 nt, Artificial Sequence
  mmSKRIPTE0008660_S1pr1_1
  gRNA
agcuucguccggcuugagcg

SEQ ID NO: 137882 - RNA, 20 nt, Artificial Sequence
  mmSKRIPTE0008661_S1pr1_2
  gRNA
uuucuccaggcaaacgcuag

SEQ ID NO: 137883 - RNA, 20 nt, Artificial Sequence
  mmSKRIPTE0008662_S1pr1_3
  gRNA
gccuggugauaccaugaugu

SEQ ID NO: 137884 - RNA, 20 nt, Artificial Sequence
  mmSKRIPTE0008663_S1pr1_4
  gRNA
aggcaaguugaacaucgggg

SEQ ID NO: 137885 - RNA, 20 nt, Artificial Sequence
  mmSKRIPTE0008664_S1pr1_5
  gRNA
ccucgcaggcuccggcuaug

SEQ ID NO: 137886 - RNA, 20 nt, Artificial Sequence
  mmSKRIPTE0008665_S1pr1_6
  gRNA
ucagaguccgucccgcgcug

SEQ ID NO: 137887 - RNA, 20 nt, Artificial Sequence
  mmSKRIPTE0008666_S1pr1_7
  gRNA
uagcugcuaauugugucccc

SEQ ID NO: 137888 - RNA, 20 nt, Artificial Sequence
  mmSKRIPTE0008667_S1pr1_8
  gRNA
gcagcaagaugcggaucgcg

SEQ ID NO: 137889 - RNA, 20 nt, Artificial Sequence
  mmSKRIPTE0008668_S1pr1_9
  gRNA
gguguccacuagcaucccgg

SEQ ID NO: 137890 - RNA, 20 nt, Artificial Sequence
  mmSKRIPTE0008669_Pglyrp1_1
  gRNA
augugaccgagauucaccgg

SEQ ID NO: 137891 - RNA, 20 nt, Artificial Sequence
  mmSKRIPTE0008670_Pglyrp1_2
  gRNA
gcccagaagauaaaguacac

SEQ ID NO: 137892 - RNA, 20 nt, Artificial Sequence
  mmSKRIPTE0008671_Pglyrp1_3
  gRNA
ugggucggaaagucccgccc

SEQ ID NO: 137893 - RNA, 20 nt, Artificial Sequence
  mmSKRIPTE0008672_Pglyrp1_4
  gRNA
ucagaucccuagguaaggga

SEQ ID NO: 137894 - RNA, 20 nt, Artificial Sequence
  mmSKRIPTE0008673_Pglyrp1_5
  gRNA
ggggcacccaguucgcuacg

SEQ ID NO: 137895 - RNA, 20 nt, Artificial Sequence
  mmSKRIPTE0008674_Pglyrp1_6
  gRNA
gccccuaauacccaauaccc

SEQ ID NO: 137896 - RNA, 20 nt, Artificial Sequence
  mmSKRIPTE0008675_Pglyrp1_7
  gRNA
gccccaccucugguuaaagg

SEQ ID NO: 137897 - RNA, 20 nt, Artificial Sequence
  mmSKRIPTE0008676_Pglyrp1_8
  gRNA
gcggggcacgaugaaacugc

SEQ ID NO: 137898 - RNA, 20 nt, Artificial Sequence
  mmSKRIPTE0008677_Pglyrp1_9
  gRNA
augcccacucacuuggugca

SEQ ID NO: 137899 - RNA, 20 nt, Artificial Sequence
  mmSKRIPTE0008678_Nlrp9a_1
  gRNA
caaacaauaauauccgugug

SEQ ID NO: 137900 - RNA, 20 nt, Artificial Sequence
  mmSKRIPTE0008679_Nlrp9a_2
  gRNA
uauaaggacccuaugcaccu

SEQ ID NO: 137901 - RNA, 20 nt, Artificial Sequence
  mmSKRIPTE0008680_Nlrp9a_3
  gRNA
cuacuaacuaccauggcggg

SEQ ID NO: 137902 - RNA, 20 nt, Artificial Sequence
  mmSKRIPTE0008681_Nlrp9a_4
  gRNA
caaggaguuaacuugcucag

SEQ ID NO: 137903 - RNA, 20 nt, Artificial Sequence
  mmSKRIPTE0008682_Nlrp9a_5
  gRNA
gcauaacguaguccaaugcu

SEQ ID NO: 137904 - RNA, 20 nt, Artificial Sequence
  mmSKRIPTE0008683_Nlrp9a_6
  gRNA
agaacugcuaccuuauagca

SEQ ID NO: 137905 - RNA, 20 nt, Artificial Sequence
  mmSKRIPTE0008684_Nlrp9a_7
  gRNA
ugaagaaccagauaucgagg

SEQ ID NO: 137906 - RNA, 20 nt, Artificial Sequence
  mmSKRIPTE0008685_Nlrp9a_8
  gRNA
uuuaagaaauacuguaaacg

SEQ ID NO: 137907 - RNA, 20 nt, Artificial Sequence
  mmSKRIPTE0008686_Nlrp9a_9
  gRNA
uuucuccuaggaguugagcg

SEQ ID NO: 137908 - RNA, 20 nt, Artificial Sequence
  mmSKRIPTE0008687_Iugb1_1
  gRNA
guggucaauccgaaguauga

SEQ ID NO: 137909 - RNA, 20 nt, Artificial Sequence
  mmSKRIPTE0008688_Iugb1_2
  gRNA
gguaccgcgcugaaccaccg

SEQ ID NO: 137910 - RNA, 20 nt, Artificial Sequence
  mmSKRIPTE0008689_Iugb1_3
  gRNA
gcuacuauaagauuaccccg

SEQ ID NO: 137911 - RNA, 20 nt, Artificial Sequence
  mmSKRIPTE0008690_Iugb1_4
  gRNA
ugaagcuaucgugcauguug

SEQ ID NO: 137912 - RNA, 20 nt, Artificial Sequence
  mmSKRIPTE0008691_Iugb1_5
  gRNA
uaauggccauaccaaucuaa

SEQ ID NO: 137913 - RNA, 20 nt, Artificial Sequence
  mmSKRIPTE0008692_Iugb1_6
  gRNA
acacugcuagugccaaugca

SEQ ID NO: 137914 - RNA, 20 nt, Artificial Sequence
  mmSKRIPTE0008693_Iugb1_7
  gRNA
agcacacacauaccacguug

SEQ ID NO: 137915 - RNA, 20 nt, Artificial Sequence
  mmSKRIPTE0008694_Iugb1_8
  gRNA
gagcccagucugucacaccg

SEQ ID NO: 137916 - RNA, 20 nt, Artificial Sequence
  mmSKRIPTE0008695_Iugb1_9
  gRNA
gcuaaccaggcgugucucug

SEQ ID NO: 137917 - RNA, 20 nt, Artificial Sequence
  mmSKRIPTE0008696_Gaua1_1
  gRNA
ggauaaagccggaaaccacg

SEQ ID NO: 137918 - RNA, 20 nt, Artificial Sequence
  mmSKRIPTE0008697_Gaua1_2
  gRNA
cagcaguagugggaauugug

SEQ ID NO: 137919 - RNA, 20 nt, Artificial Sequence
  mmSKRIPTE0008698_Gaua1_3
  gRNA
cucuggcggaggaaugccag

SEQ ID NO: 137920 - RNA, 20 nt, Artificial Sequence
  mmSKRIPTE0008699_Gaua1_4
  gRNA
auagguugccccuaaaacgg

SEQ ID NO: 137921 - RNA, 20 nt, Artificial Sequence
  mmSKRIPTE0008700_Gaua1_5
  gRNA
uggacaccuugaagacggag

SEQ ID NO: 137922 - RNA, 20 nt, Artificial Sequence
  mmSKRIPTE0008701_Gaua1_6
  gRNA
aguccuaucaggccaaccug

SEQ ID NO: 137923 - RNA, 20 nt, Artificial Sequence
  mmSKRIPTE0008702_Gaua1_7
  gRNA
gagcaacggcuacuccacug

SEQ ID NO: 137924 - RNA, 20 nt, Artificial Sequence
  mmSKRIPTE0008703_Gaua1_8
  gRNA
gacgaggauugguacaaaug

SEQ ID NO: 137925 - RNA, 20 nt, Artificial Sequence
  mmSKRIPTE0008704_Gaua1_9
  gRNA
aauccagacgaggaaccgca

SEQ ID NO: 137926 - RNA, 20 nt, Artificial Sequence
  mmSKRIPTE0008705_Il10_1
  gRNA
aucuuauucgaauuacagug

SEQ ID NO: 137927 - RNA, 20 nt, Artificial Sequence
  mmSKRIPTE0008706_Il10_2
  gRNA
uugagcucggaucagaucag

SEQ ID NO: 137928 - RNA, 20 nt, Artificial Sequence
  mmSKRIPTE0008707_Il10_3
  gRNA
uucggagagagguacaaacg

SEQ ID NO: 137929 - RNA, 20 nt, Artificial Sequence
  mmSKRIPTE0008708_Il10_4
  gRNA
uauuucgguagggacugagg

SEQ ID NO: 137930 - RNA, 20 nt, Artificial Sequence
  mmSKRIPTE0008709_Il10_5
  gRNA
ccaagcgauuagggacggga

SEQ ID NO: 137931 - RNA, 20 nt, Artificial Sequence
  mmSKRIPTE0008710_Il10_6
  gRNA
cggcugggggaugacaguag

SEQ ID NO: 137932 - RNA, 20 nt, Artificial Sequence
  mmSKRIPTE0008711_Il10_7
  gRNA
ggcaacccaaguaacccuag

SEQ ID NO: 137933 - RNA, 20 nt, Artificial Sequence
  mmSKRIPTE0008712_Il10_8
  gRNA
guaagcgcuaaagaacuggu

SEQ ID NO: 137934 - RNA, 20 nt, Artificial Sequence
  mmSKRIPTE0008713_Il10_9
  gRNA
acucaccaaagcgcagaagg

SEQ ID NO: 137935 - RNA, 20 nt, Artificial Sequence
  mmSKRIPTE0008714_Dusp3_1
  gRNA
guaggcgauaacuagcguug

SEQ ID NO: 137936 - RNA, 20 nt, Artificial Sequence
  mmSKRIPTE0008715_Dusp3_2
  gRNA
gcuccuccgcuucaugcgcg

SEQ ID NO: 137937 - RNA, 20 nt, Artificial Sequence
  mmSKRIPTE0008716_Dusp3_3
  gRNA
aggccaauuacaccugcagu

SEQ ID NO: 137938 - RNA, 20 nt, Artificial Sequence
  mmSKRIPTE0008717_Dusp3_4
  gRNA
ucuucagcauucugucaacg

SEQ ID NO: 137939 - RNA, 20 nt, Artificial Sequence
  mmSKRIPTE0008718_Dusp3_5
  gRNA
aaugaacaggcagccccgga

SEQ ID NO: 137940 - RNA, 20 nt, Artificial Sequence
  mmSKRIPTE0008719_Dusp3_6
  gRNA
acgggcuccuuauugccaag

SEQ ID NO: 137941 - RNA, 20 nt, Artificial Sequence
  mmSKRIPTE0008720_Dusp3_7
  gRNA
uguccuacaugugagccgau

SEQ ID NO: 137942 - RNA, 20 nt, Artificial Sequence
  mmSKRIPTE0008721_Dusp3_8
  gRNA
gcugaaugagagcuggcuag

SEQ ID NO: 137943 - RNA, 20 nt, Artificial Sequence
  mmSKRIPTE0008722_Dusp3_9
  gRNA
gcggcaggaagacuuaaccc

SEQ ID NO: 137944 - RNA, 20 nt, Artificial Sequence
  mmSKRIPTE0008723_Ighg2c_1
  gRNA
gacaaggacaucuauccuag

SEQ ID NO: 137945 - RNA, 20 nt, Artificial Sequence
  mmSKRIPTE0008724_Ighg2c_2
  gRNA
gggagauggucuuagucgua

SEQ ID NO: 137946 - RNA, 20 nt, Artificial Sequence
  mmSKRIPTE0008725_Ighg2c_3
  gRNA
agacggaugguccacccaag

SEQ ID NO: 137947 - RNA, 20 nt, Artificial Sequence
  mmSKRIPTE0008726_Ighg2c_4
  gRNA
acguccuacuacaucugggg

SEQ ID NO: 137948 - RNA, 20 nt, Artificial Sequence
  mmSKRIPTE0008727_Ighg2c_5
  gRNA
caggcauccuagagucaccg

SEQ ID NO: 137949 - RNA, 20 nt, Artificial Sequence
  mmSKRIPTE0008728_Ighg2c_6
  gRNA
guggccucauaaauuuggag

SEQ ID NO: 137950 - RNA, 20 nt, Artificial Sequence
  mmSKRIPTE0008729_Ighg2c_7
  gRNA
gccaguguccauuaggaccc

SEQ ID NO: 137951 - RNA, 20 nt, Artificial Sequence
  mmSKRIPTE0008730_Ighg2c_8
  gRNA
gcaucauuggagucagcugg

SEQ ID NO: 137952 - RNA, 20 nt, Artificial Sequence
  mmSKRIPTE0008731_Ighg2c_9
  gRNA
ggugauugugcagacccucg

SEQ ID NO: 137953 - RNA, 20 nt, Artificial Sequence
  mmSKRIPTE0008732_Naip2_1
  gRNA
gagguuaacacuucaaugug

SEQ ID NO: 137954 - RNA, 20 nt, Artificial Sequence
  mmSKRIPTE0008733_Naip2_2
  gRNA
gaaauuggugagugucgaag

SEQ ID NO: 137955 - RNA, 20 nt, Artificial Sequence
  mmSKRIPTE0008734_Naip2_3
  gRNA
gacucagcaacacgauugug

SEQ ID NO: 137956 - RNA, 20 nt, Artificial Sequence
  mmSKRIPTE0008735_Naip2_4
  gRNA
augaaccagagucugcggaa

SEQ ID NO: 137957 - RNA, 20 nt, Artificial Sequence
  mmSKRIPTE0008736_Naip2_5
  gRNA
ucuccaaacuagguaaggga

SEQ ID NO: 137958 - RNA, 20 nt, Artificial Sequence
  mmSKRIPTE0008737_Naip2_6
  gRNA
augcuugugucaaaacuggg

SEQ ID NO: 137959 - RNA, 20 nt, Artificial Sequence
  mmSKRIPTE0008738_Naip2_7
  gRNA
acagccccgggugauucgug

SEQ ID NO: 137960 - RNA, 20 nt, Artificial Sequence
  mmSKRIPTE0008739_Naip2_8
  gRNA
ucauugcaggaaaccacccg

SEQ ID NO: 137961 - RNA, 20 nt, Artificial Sequence
  mmSKRIPTE0008740_Naip2_9
  gRNA
gaauccaugguggaugcaug

SEQ ID NO: 137962 - RNA, 20 nt, Artificial Sequence
  mmSKRIPTE0008741_H2-Q4_1
  gRNA
ggaaccaaucaucgucgccg

SEQ ID NO: 137963 - RNA, 20 nt, Artificial Sequence
  mmSKRIPTE0008742_H2-Q4_2
  gRNA
guucugagcagaacggacgc

SEQ ID NO: 137964 - RNA, 20 nt, Artificial Sequence
  mmSKRIPTE0008743_H2-Q4_3
  gRNA
gggugaguaccggguccgga

SEQ ID NO: 137965 - RNA, 20 nt, Artificial Sequence
  mmSKRIPTE0008744_H2-Q4_4
  gRNA
ggugaucacgucacccaaug

SEQ ID NO: 137966 - RNA, 20 nt, Artificial Sequence
  mmSKRIPTE0008745_H2-Q4_5
  gRNA
aaaucccacaauuagcuggu

SEQ ID NO: 137967 - RNA, 20 nt, Artificial Sequence
  mmSKRIPTE0008746_H2-Q4_6
  gRNA
gcaaugauggccaagcucca

SEQ ID NO: 137968 - RNA, 20 nt, Artificial Sequence
  mmSKRIPTE0008747_H2-Q4_7
  gRNA
auuucuacaccuccgugucc

SEQ ID NO: 137969 - RNA, 20 nt, Artificial Sequence
  mmSKRIPTE0008748_H2-Q4_8
  gRNA
ugacaucaccgucagaucug

SEQ ID NO: 137970 - RNA, 20 nt, Artificial Sequence
  mmSKRIPTE0008749_H2-Q4_9
  gRNA
guuuccacugcagacccgga

SEQ ID NO: 137971 - RNA, 20 nt, Artificial Sequence
  mmSKRIPTE0008750_H2-M10.5_1
  gRNA
cagugagacagcaagcguug

SEQ ID NO: 137972 - RNA, 20 nt, Artificial Sequence
  mmSKRIPTE0008751_H2-M10.5_2
  gRNA
gagauucauccauagucgaa

SEQ ID NO: 137973 - RNA, 20 nt, Artificial Sequence
  mmSKRIPTE0008752_H2-M10.5_3
  gRNA
gugguaugccuauggaccug

SEQ ID NO: 137974 - RNA, 20 nt, Artificial Sequence
  mmSKRIPTE0008753_H2-M10.5_4
  gRNA
aauuuggggacaaaaucccg

SEQ ID NO: 137975 - RNA, 20 nt, Artificial Sequence
  mmSKRIPTE0008754_H2-M10.5_5
  gRNA
ugagccggaagugaccgccg

SEQ ID NO: 137976 - RNA, 20 nt, Artificial Sequence
  mmSKRIPTE0008755_H2-M10.5_6
  gRNA
uuaccugcaaggagugugcg

SEQ ID NO: 137977 - RNA, 20 nt, Artificial Sequence
  mmSKRIPTE0008756_H2-M10.5_7
  gRNA
cauguugagucaggacaccg

SEQ ID NO: 137978 - RNA, 20 nt, Artificial Sequence
  mmSKRIPTE0008757_H2-M10.5_8
  gRNA
augcugcauugccauaggca

SEQ ID NO: 137979 - RNA, 20 nt, Artificial Sequence
  mmSKRIPTE0008758_H2-M10.5_9
  gRNA
gcgagggucugguuaggcaa

SEQ ID NO: 137980 - RNA, 20 nt, Artificial Sequence
  mmSKRIPTE0008759_Hells_1
  gRNA
ucuuucgcgggaaaacccgg

SEQ ID NO: 137981 - RNA, 20 nt, Artificial Sequence
  mmSKRIPTE0008760_Hells_2
  gRNA
gggugugaggauuuagcucg

SEQ ID NO: 137982 - RNA, 20 nt, Artificial Sequence
  mmSKRIPTE0008761_Hells_3
  gRNA
gcucuguaaugauuauuacg

SEQ ID NO: 137983 - RNA, 20 nt, Artificial Sequence
  mmSKRIPTE0008762_Hells_4
  gRNA
gguaauguaaaguccacggc

SEQ ID NO: 137984 - RNA, 20 nt, Artificial Sequence
  mmSKRIPTE0008763_Hells_5
  gRNA
cuggugccaauaacagaaga

SEQ ID NO: 137985 - RNA, 20 nt, Artificial Sequence
  mmSKRIPTE0008764_Hells_6
  gRNA
agaagaauaaauugacgaca

SEQ ID NO: 137986 - RNA, 20 nt, Artificial Sequence
  mmSKRIPTE0008765_Hells_7
  gRNA
cguccaaaucucgugagccg

SEQ ID NO: 137987 - RNA, 20 nt, Artificial Sequence
  mmSKRIPTE0008766_Hells_8
  gRNA
uuagauauacaguuucaaca

SEQ ID NO: 137988 - RNA, 20 nt, Artificial Sequence
  mmSKRIPTE0008767_Hells_9
  gRNA
uaauaguagaugaaggacac

SEQ ID NO: 137989 - RNA, 20 nt, Artificial Sequence
  mmSKRIPTE0008768_Chuk_1
  gRNA
guagaagaccucccuucccg

SEQ ID NO: 137990 - RNA, 20 nt, Artificial Sequence
  mmSKRIPTE0008769_Chuk_2
  gRNA
cucccuggcgucguccauag

SEQ ID NO: 137991 - RNA, 20 nt, Artificial Sequence
  mmSKRIPTE0008770_Chuk_3
  gRNA
aauaggaaccgcacgcacga

SEQ ID NO: 137992 - RNA, 20 nt, Artificial Sequence
  mmSKRIPTE0008771_Chuk_4
  gRNA
aaaaguccaaccccuuacac

SEQ ID NO: 137993 - RNA, 20 nt, Artificial Sequence
  mmSKRIPTE0008772_Chuk_5
  gRNA
aaaccgauaccgauaaguca

SEQ ID NO: 137994 - RNA, 20 nt, Artificial Sequence
  mmSKRIPTE0008773_Chuk_6
  gRNA
gcauccacacuaccuuccgg

SEQ ID NO: 137995 - RNA, 20 nt, Artificial Sequence
  mmSKRIPTE0008774_Chuk_7
  gRNA
ucuugaagguugauguagug

SEQ ID NO: 137996 - RNA, 20 nt, Artificial Sequence
  mmSKRIPTE0008775_Chuk_8
  gRNA
gguaaggugagguccacuaa

SEQ ID NO: 137997 - RNA, 20 nt, Artificial Sequence
  mmSKRIPTE0008776_Chuk_9
  gRNA
aggggcgcuuagugugacug

SEQ ID NO: 137998 - RNA, 20 nt, Artificial Sequence
  mmSKRIPTE0008777_Kynu_1
  gRNA
ccauaaucucauauucccug

SEQ ID NO: 137999 - RNA, 20 nt, Artificial Sequence
  mmSKRIPTE0008778_Kynu_2
  gRNA
auguguuugggcauacgcug

SEQ ID NO: 138000 - RNA, 20 nt, Artificial Sequence
  mmSKRIPTE0008779_Kynu_3
  gRNA
cuuugagcucuguaggcgag

SEQ ID NO: 138001 - RNA, 20 nt, Artificial Sequence
  mmSKRIPTE0008780_Kynu_4
  gRNA
cuuggagacacuacucacgc

SEQ ID NO: 138002 - RNA, 20 nt, Artificial Sequence
  mmSKRIPTE0008781_Kynu_5
  gRNA
gcacagcaccguuaauagag

SEQ ID NO: 138003 - RNA, 20 nt, Artificial Sequence
  mmSKRIPTE0008782_Kynu_6
  gRNA
agcugauugaaaaguauacg

SEQ ID NO: 138004 - RNA, 20 nt, Artificial Sequence
  mmSKRIPTE0008783_Kynu_7
  gRNA
auccuccuuaaugugaauca

SEQ ID NO: 138005 - RNA, 20 nt, Artificial Sequence
  mmSKRIPTE0008784_Kynu_8
  gRNA
aaagaacacgaggcucgggu

SEQ ID NO: 138006 - RNA, 20 nt, Artificial Sequence
  mmSKRIPTE0008785_Kynu_9
  gRNA
gagcuaaugugacugcaacg

SEQ ID NO: 138007 - RNA, 20 nt, Artificial Sequence
  mmSKRIPTE0008786_Gbp2b_1
  gRNA
gcucaccggaguucuugaug

SEQ ID NO: 138008 - RNA, 20 nt, Artificial Sequence
  mmSKRIPTE0008787_Gbp2b_2
  gRNA
agguagagggaugacuuacg

SEQ ID NO: 138009 - RNA, 20 nt, Artificial Sequence
  mmSKRIPTE0008788_Gbp2b_3
  gRNA
uacuggagaaugucuaacug

SEQ ID NO: 138010 - RNA, 20 nt, Artificial Sequence
  mmSKRIPTE0008789_Gbp2b_4
  gRNA
cagcuguugguagcauauug

SEQ ID NO: 138011 - RNA, 20 nt, Artificial Sequence
  mmSKRIPTE0008790_Gbp2b_5
  gRNA
aggacugcguucuccauaca

SEQ ID NO: 138012 - RNA, 20 nt, Artificial Sequence
  mmSKRIPTE0008791_Gbp2b_6
  gRNA
uugguucccaggguagacaa

SEQ ID NO: 138013 - RNA, 20 nt, Artificial Sequence
  mmSKRIPTE0008792_Gbp2b_7
  gRNA
uaaaguauggugcaugaucg

SEQ ID NO: 138014 - RNA, 20 nt, Artificial Sequence
  mmSKRIPTE0008793_Gbp2b_8
  gRNA
guguaucacuuaccuaacau

SEQ ID NO: 138015 - RNA, 20 nt, Artificial Sequence
  mmSKRIPTE0008794_Gbp2b_9
  gRNA
uggagggacaauaaaacacc

SEQ ID NO: 138016 - RNA, 20 nt, Artificial Sequence
  mmSKRIPTE0008795_Edn2_1
  gRNA
ugacucuaauagcucccacg

SEQ ID NO: 138017 - RNA, 20 nt, Artificial Sequence
  mmSKRIPTE0008796_Edn2_2
  gRNA
acugggggcauagagcggug

SEQ ID NO: 138018 - RNA, 20 nt, Artificial Sequence
  mmSKRIPTE0008797_Edn2_3
  gRNA
acggccugggaaacccgcca

SEQ ID NO: 138019 - RNA, 20 nt, Artificial Sequence
  mmSKRIPTE0008798_Edn2_4
  gRNA
guaagcauccaccaggaccg

SEQ ID NO: 138020 - RNA, 20 nt, Artificial Sequence
  mmSKRIPTE0008799_Edn2_5
  gRNA
aggagcaucgacgaaaacgc

SEQ ID NO: 138021 - RNA, 20 nt, Artificial Sequence
  mmSKRIPTE0008800_Edn2_6
  gRNA
gggaucgcaacacgcgagag

SEQ ID NO: 138022 - RNA, 20 nt, Artificial Sequence
  mmSKRIPTE0008801_Edn2_7
  gRNA
uggccgccucuuauaauacc

SEQ ID NO: 138023 - RNA, 20 nt, Artificial Sequence
  mmSKRIPTE0008802_Edn2_8
  gRNA
auucauugaugucuccuccg

SEQ ID NO: 138024 - RNA, 20 nt, Artificial Sequence
  mmSKRIPTE0008803_Edn2_9
  gRNA
gagagcccauaaguacacug

SEQ ID NO: 138025 - RNA, 20 nt, Artificial Sequence
  mmSKRIPTE0008804_Mir17_1
  gRNA
ucgucggucagucggucgcg

SEQ ID NO: 138026 - RNA, 20 nt, Artificial Sequence
  mmSKRIPTE0008805_Mir17_2
  gRNA
auuacagcuuauacccaagg

SEQ ID NO: 138027 - RNA, 20 nt, Artificial Sequence
  mmSKRIPTE0008806_Mir17_3
  gRNA
gaauaaagugaaccucaccu

SEQ ID NO: 138028 - RNA, 20 nt, Artificial Sequence
  mmSKRIPTE0008807_Mir17_4
  gRNA
ugugugcaucuacugcagug

SEQ ID NO: 138029 - RNA, 20 nt, Artificial Sequence
  mmSKRIPTE0008808_Mir17_5
  gRNA
augcugacagcugccucggu

SEQ ID NO: 138030 - RNA, 20 nt, Artificial Sequence
  mmSKRIPTE0008809_Mir17_6
  gRNA
acauaacuucuuaugccaga

SEQ ID NO: 138031 - RNA, 20 nt, Artificial Sequence
  mmSKRIPTE0008810_Mir17_7
  gRNA
aaaaagcacgcagcaccagc

SEQ ID NO: 138032 - RNA, 20 nt, Artificial Sequence
  mmSKRIPTE0008811_Mir17_8
  gRNA
cacuuugacauuauucugac

SEQ ID NO: 138033 - RNA, 20 nt, Artificial Sequence
  mmSKRIPTE0008812_Slamf8_1
  gRNA
uaggggagcagcagacgggu

SEQ ID NO: 138034 - RNA, 20 nt, Artificial Sequence
  mmSKRIPTE0008813_Slamf8_2
  gRNA
cagacacuacuaauaguaca

SEQ ID NO: 138035 - RNA, 20 nt, Artificial Sequence
  mmSKRIPTE0008814_Slamf8_3
  gRNA
cuaguucaccuugcccagag

SEQ ID NO: 138036 - RNA, 20 nt, Artificial Sequence
  mmSKRIPTE0008815_Slamf8_4
  gRNA
agauggacaaccuguccucg

SEQ ID NO: 138037 - RNA, 20 nt, Artificial Sequence
  mmSKRIPTE0008816_Slamf8_5
  gRNA
uccggcaugugcgaacagga

SEQ ID NO: 138038 - RNA, 20 nt, Artificial Sequence
  mmSKRIPTE0008817_Slamf8_6
  gRNA
ucacgcacuuggaagcccgg

SEQ ID NO: 138039 - RNA, 20 nt, Artificial Sequence
  mmSKRIPTE0008818_Slamf8_7
  gRNA
uguucccugacuuagcaacg

SEQ ID NO: 138040 - RNA, 20 nt, Artificial Sequence
  mmSKRIPTE0008819_Slamf8_8
  gRNA
guaugacaggcgaugcaaag

SEQ ID NO: 138041 - RNA, 20 nt, Artificial Sequence
  mmSKRIPTE0008820_Slamf8_9
  gRNA
accguacaccuugagauaca

SEQ ID NO: 138042 - RNA, 20 nt, Artificial Sequence
  mmSKRIPTE0008821_Aim2_1
  gRNA
ugccaggagcacacucgacg

SEQ ID NO: 138043 - RNA, 20 nt, Artificial Sequence
  mmSKRIPTE0008822_Aim2_2
  gRNA
uaauuggaaacuuaacgaca

SEQ ID NO: 138044 - RNA, 20 nt, Artificial Sequence
  mmSKRIPTE0008823_Aim2_3
  gRNA
aaaauguuaacugcuugccg

SEQ ID NO: 138045 - RNA, 20 nt, Artificial Sequence
  mmSKRIPTE0008824_Aim2_4
  gRNA
aaacugcggaaauggcaggu

SEQ ID NO: 138046 - RNA, 20 nt, Artificial Sequence
  mmSKRIPTE0008825_Aim2_5
  gRNA
cuugucggagagacgccugu

SEQ ID NO: 138047 - RNA, 20 nt, Artificial Sequence
  mmSKRIPTE0008826_Aim2_6
  gRNA
cggccuggaccacaucacgg

SEQ ID NO: 138048 - RNA, 20 nt, Artificial Sequence
  mmSKRIPTE0008827_Aim2_7
  gRNA
gcgcggagguggauagucca

SEQ ID NO: 138049 - RNA, 20 nt, Artificial Sequence
  mmSKRIPTE0008828_Aim2_8
  gRNA
uccaugcaguagaagcgcaa

SEQ ID NO: 138050 - RNA, 20 nt, Artificial Sequence
  mmSKRIPTE0008829_Aim2_9
  gRNA
auaucucuccuaucguagcc

SEQ ID NO: 138051 - RNA, 20 nt, Artificial Sequence
  mmSKRIPTE0008830_H60b_1
  gRNA
acuguccauguagaguacga

SEQ ID NO: 138052 - RNA, 20 nt, Artificial Sequence
  mmSKRIPTE0008831_H60b_2
  gRNA
uuguugacuuuggaccagag

SEQ ID NO: 138053 - RNA, 20 nt, Artificial Sequence
  mmSKRIPTE0008832_H60b_3
  gRNA
guacucaccaguugacagug

SEQ ID NO: 138054 - RNA, 20 nt, Artificial Sequence
  mmSKRIPTE0008833_H60b_4
  gRNA
ugcaucccaaggaacucaug

SEQ ID NO: 138055 - RNA, 20 nt, Artificial Sequence
  mmSKRIPTE0008834_H60b_5
  gRNA
uucaggacucccacaccccg

SEQ ID NO: 138056 - RNA, 20 nt, Artificial Sequence
  mmSKRIPTE0008835_H60b_6
  gRNA
acaaguaccuggcuaaguca

SEQ ID NO: 138057 - RNA, 20 nt, Artificial Sequence
  mmSKRIPTE0008836_H60b_7
  gRNA
agcaucugagaaauagacug

SEQ ID NO: 138058 - RNA, 20 nt, Artificial Sequence
  mmSKRIPTE0008837_H60b_8
  gRNA
ggaaugagaaaggcucugcg

SEQ ID NO: 138059 - RNA, 20 nt, Artificial Sequence
  mmSKRIPTE0008838_H60b_9
  gRNA
guggacaacagccacuguga

SEQ ID NO: 138060 - RNA, 20 nt, Artificial Sequence
  mmSKRIPTE0008839_Barx1_1
  gRNA
gcccagcgaccgaaauugcg

SEQ ID NO: 138061 - RNA, 20 nt, Artificial Sequence
  mmSKRIPTE0008840_Barx1_2
  gRNA
agucaccgucuuuguaagag

SEQ ID NO: 138062 - RNA, 20 nt, Artificial Sequence
  mmSKRIPTE0008841_Barx1_3
  gRNA
gcgggcuuccgaauucguga

SEQ ID NO: 138063 - RNA, 20 nt, Artificial Sequence
  mmSKRIPTE0008842_Barx1_4
  gRNA
augaagcugcgguagcgaug

SEQ ID NO: 138064 - RNA, 20 nt, Artificial Sequence
  mmSKRIPTE0008843_Barx1_5
  gRNA
agaguaacgcacacccucag

SEQ ID NO: 138065 - RNA, 20 nt, Artificial Sequence
  mmSKRIPTE0008844_Barx1_6
  gRNA
uccuucagguagcuaucccg

SEQ ID NO: 138066 - RNA, 20 nt, Artificial Sequence
  mmSKRIPTE0008845_Barx1_7
  gRNA
caaacggcauggacgcggaa

SEQ ID NO: 138067 - RNA, 20 nt, Artificial Sequence
  mmSKRIPTE0008846_Barx1_8
  gRNA
ccaaacgcagcaaagcgcug

SEQ ID NO: 138068 - RNA, 20 nt, Artificial Sequence
  mmSKRIPTE0008847_Barx1_9
  gRNA
agagacgacucugcucugca

SEQ ID NO: 138069 - RNA, 20 nt, Artificial Sequence
  mmSKRIPTE0008848_Fga_1
  gRNA
auggaaaggaaaccaaucga

SEQ ID NO: 138070 - RNA, 20 nt, Artificial Sequence
  mmSKRIPTE0008849_Fga_2
  gRNA
gccagagcucgcccaacgag

SEQ ID NO: 138071 - RNA, 20 nt, Artificial Sequence
  mmSKRIPTE0008850_Fga_3
  gRNA
acuuaaguccggaaaugcga

SEQ ID NO: 138072 - RNA, 20 nt, Artificial Sequence
  mmSKRIPTE0008851_Fga_4
  gRNA
ccaacccuacuuaaaccggc

SEQ ID NO: 138073 - RNA, 20 nt, Artificial Sequence
  mmSKRIPTE0008852_Fga_5
  gRNA
caagaucucucguuauccua

SEQ ID NO: 138074 - RNA, 20 nt, Artificial Sequence
  mmSKRIPTE0008853_Fga_6
  gRNA
aguacguggcccaagaguug

SEQ ID NO: 138075 - RNA, 20 nt, Artificial Sequence
  mmSKRIPTE0008854_Fga_7
  gRNA
aaugguuaacuuaaucuagg

SEQ ID NO: 138076 - RNA, 20 nt, Artificial Sequence
  mmSKRIPTE0008855_Fga_8
  gRNA
gacuggguaaggcgagcaca

SEQ ID NO: 138077 - RNA, 20 nt, Artificial Sequence
  mmSKRIPTE0008856_Fga_9
  gRNA
uuuagagcaugaacgaugug

SEQ ID NO: 138078 - RNA, 20 nt, Artificial Sequence
  mmSKRIPTE0008857_Cxcl9_1
  gRNA
aguaaggcauauagguacgu

SEQ ID NO: 138079 - RNA, 20 nt, Artificial Sequence
  mmSKRIPTE0008858_Cxcl9_2
  gRNA
aaccugccuagauccggacu

SEQ ID NO: 138080 - RNA, 20 nt, Artificial Sequence
  mmSKRIPTE0008859_Cxcl9_3
  gRNA
ggucucgaaagcuacguggg

SEQ ID NO: 138081 - RNA, 20 nt, Artificial Sequence
  mmSKRIPTE0008860_Cxcl9_4
  gRNA
accacaaauugaucguccug

SEQ ID NO: 138082 - RNA, 20 nt, Artificial Sequence
  mmSKRIPTE0008861_Cxcl9_5
  gRNA
gaucugauguuaucacgacu

SEQ ID NO: 138083 - RNA, 20 nt, Artificial Sequence
  mmSKRIPTE0008862_Cxcl9_6
  gRNA
ccacgugugcgugagccuug

SEQ ID NO: 138084 - RNA, 20 nt, Artificial Sequence
  mmSKRIPTE0008863_Cxcl9_7
  gRNA
ucaccacuccuagccugaug

SEQ ID NO: 138085 - RNA, 20 nt, Artificial Sequence
  mmSKRIPTE0008864_Cxcl9_8
  gRNA
ggaguuggaccaucucgaag

SEQ ID NO: 138086 - RNA, 20 nt, Artificial Sequence
  mmSKRIPTE0008865_Cxcl9_9
  gRNA
ccagccaaucagagacggga

SEQ ID NO: 138087 - RNA, 20 nt, Artificial Sequence
  mmSKRIPTE0008866_Hsph1_1
  gRNA
gucuagcccaaccaccgaca

SEQ ID NO: 138088 - RNA, 20 nt, Artificial Sequence
  mmSKRIPTE0008867_Hsph1_2
  gRNA
cuagagccuaagccaugccg

SEQ ID NO: 138089 - RNA, 20 nt, Artificial Sequence
  mmSKRIPTE0008868_Hsph1_3
  gRNA
ccguagugacacgcuagccg

SEQ ID NO: 138090 - RNA, 20 nt, Artificial Sequence
  mmSKRIPTE0008869_Hsph1_4
  gRNA
gaccagugcugucaggacgu

SEQ ID NO: 138091 - RNA, 20 nt, Artificial Sequence
  mmSKRIPTE0008870_Hsph1_5
  gRNA
gcaagaucucccgaaugccg

SEQ ID NO: 138092 - RNA, 20 nt, Artificial Sequence
  mmSKRIPTE0008871_Hsph1_6
  gRNA
ugcacaguaauccugaugug

SEQ ID NO: 138093 - RNA, 20 nt, Artificial Sequence
  mmSKRIPTE0008872_Hsph1_7
  gRNA
gaggcaucuucccgacuggu

SEQ ID NO: 138094 - RNA, 20 nt, Artificial Sequence
  mmSKRIPTE0008873_Hsph1_8
  gRNA
aggaccguaguuaaugugaa

SEQ ID NO: 138095 - RNA, 20 nt, Artificial Sequence
  mmSKRIPTE0008874_Hsph1_9
  gRNA
gcacucguccuaacuggagu

SEQ ID NO: 138096 - RNA, 20 nt, Artificial Sequence
  mmSKRIPTE0008875_Fzd5_1
  gRNA
ucacacucaagacuccggag

SEQ ID NO: 138097 - RNA, 20 nt, Artificial Sequence
  mmSKRIPTE0008876_Fzd5_2
  gRNA
gcuugugguaugcggcggug

SEQ ID NO: 138098 - RNA, 20 nt, Artificial Sequence
  mmSKRIPTE0008877_Fzd5_3
  gRNA
gcagcacuugaacugcgcgg

SEQ ID NO: 138099 - RNA, 20 nt, Artificial Sequence
  mmSKRIPTE0008878_Fzd5_4
  gRNA
cgggugaacugggaagacgc

SEQ ID NO: 138100 - RNA, 20 nt, Artificial Sequence
  mmSKRIPTE0008879_Fzd5_5
  gRNA
ucucggcggggccacaagag

SEQ ID NO: 138101 - RNA, 20 nt, Artificial Sequence
  mmSKRIPTE0008880_Fzd5_6
  gRNA
gauucggagucgcgcgacug

SEQ ID NO: 138102 - RNA, 20 nt, Artificial Sequence
  mmSKRIPTE0008881_Fzd5_7
  gRNA
ggacccggagagcgauucgu

SEQ ID NO: 138103 - RNA, 20 nt, Artificial Sequence
  mmSKRIPTE0008882_Fzd5_8
  gRNA
gcucugcccgaaucaugcag

SEQ ID NO: 138104 - RNA, 20 nt, Artificial Sequence
  mmSKRIPTE0008883_Fzd5_9
  gRNA
ggaaucguuccaugucaaug

SEQ ID NO: 138105 - RNA, 20 nt, Artificial Sequence
  mmSKRIPTE0008884_Il20_1
  gRNA
agaaucucacuagaugacga

SEQ ID NO: 138106 - RNA, 20 nt, Artificial Sequence
  mmSKRIPTE0008885_Il20_2
  gRNA
aauaguucacuauggcccua

SEQ ID NO: 138107 - RNA, 20 nt, Artificial Sequence
  mmSKRIPTE0008886_Il20_3
  gRNA
accacauucacguagugcca

SEQ ID NO: 138108 - RNA, 20 nt, Artificial Sequence
  mmSKRIPTE0008887_Il20_4
  gRNA
cugagacuggaauuaacgaa

SEQ ID NO: 138109 - RNA, 20 nt, Artificial Sequence
  mmSKRIPTE0008888_Il20_5
  gRNA
aaggucuggauuugauccgg

SEQ ID NO: 138110 - RNA, 20 nt, Artificial Sequence
  mmSKRIPTE0008889_Il20_6
  gRNA
cuguucaguucccacccagu

SEQ ID NO: 138111 - RNA, 20 nt, Artificial Sequence
  mmSKRIPTE0008890_Il20_7
  gRNA
aaaugccucucacuagaccc

SEQ ID NO: 138112 - RNA, 20 nt, Artificial Sequence
  mmSKRIPTE0008891_Il20_8
  gRNA
auguucguauggauuguggg

SEQ ID NO: 138113 - RNA, 20 nt, Artificial Sequence
  mmSKRIPTE0008892_Il20_9
  gRNA
guguugguuacauaguugga

SEQ ID NO: 138114 - RNA, 20 nt, Artificial Sequence
  mmSKRIPTE0008893_Nfe2l1_1
  gRNA
auccgggauauccggcgccg

SEQ ID NO: 138115 - RNA, 20 nt, Artificial Sequence
  mmSKRIPTE0008894_Nfe2l1_2
  gRNA
uuguuaccuaggcugccgca

SEQ ID NO: 138116 - RNA, 20 nt, Artificial Sequence
  mmSKRIPTE0008895_Nfe2l1_3
  gRNA
agggcacguaacuacaagcu

SEQ ID NO: 138117 - RNA, 20 nt, Artificial Sequence
  mmSKRIPTE0008896_Nfe2l1_4
  gRNA
uaggcccuauaaguguaaca

SEQ ID NO: 138118 - RNA, 20 nt, Artificial Sequence
  mmSKRIPTE0008897_Nfe2l1_5
  gRNA
ccauaguuaggaaccccuug

SEQ ID NO: 138119 - RNA, 20 nt, Artificial Sequence
  mmSKRIPTE0008898_Nfe2l1_6
  gRNA
ccuccucauuccucgcacga

SEQ ID NO: 138120 - RNA, 20 nt, Artificial Sequence
  mmSKRIPTE0008899_Nfe2l1_7
  gRNA
gucagaaaagugcaccugca

SEQ ID NO: 138121 - RNA, 20 nt, Artificial Sequence
  mmSKRIPTE0008900_Nfe2l1_8
  gRNA
ggccccucggagcuaccaag

SEQ ID NO: 138122 - RNA, 20 nt, Artificial Sequence
  mmSKRIPTE0008901_Nfe2l1_9
  gRNA
uauggaacacagacauggcg

SEQ ID NO: 138123 - RNA, 20 nt, Artificial Sequence
  mmSKRIPTE0008902_H2-M10.1_1
  gRNA
augcaggugaagcaaaacgg

SEQ ID NO: 138124 - RNA, 20 nt, Artificial Sequence
  mmSKRIPTE0008903_H2-M10.1_2
  gRNA
uaguuggggacaaaaucccg

SEQ ID NO: 138125 - RNA, 20 nt, Artificial Sequence
  mmSKRIPTE0008904_H2-M10.1_3
  gRNA
ucaacacgcgaagagcaggu

SEQ ID NO: 138126 - RNA, 20 nt, Artificial Sequence
  mmSKRIPTE0008905_H2-M10.1_4
  gRNA
gcuucuaguagguuucccaa

SEQ ID NO: 138127 - RNA, 20 nt, Artificial Sequence
  mmSKRIPTE0008906_H2-M10.1_5
  gRNA
ggaauggucucguuagacaa

SEQ ID NO: 138128 - RNA, 20 nt, Artificial Sequence
  mmSKRIPTE0008907_H2-M10.1_6
  gRNA
ugagucgguagugaccgccg

SEQ ID NO: 138129 - RNA, 20 nt, Artificial Sequence
  mmSKRIPTE0008908_H2-M10.1_7
  gRNA
gagaaccauagauugugacc

SEQ ID NO: 138130 - RNA, 20 nt, Artificial Sequence
  mmSKRIPTE0008909_H2-M10.1_8
  gRNA
cuucacuuuacaacccgaug

SEQ ID NO: 138131 - RNA, 20 nt, Artificial Sequence
  mmSKRIPTE0008910_H2-M10.1_9
  gRNA
accccaauaagcucgacucu

SEQ ID NO: 138132 - RNA, 20 nt, Artificial Sequence
  mmSKRIPTE0008911_Tnfsf15_1
  gRNA
acaaagcaaauacagaccgg

SEQ ID NO: 138133 - RNA, 20 nt, Artificial Sequence
  mmSKRIPTE0008912_Tnfsf15_2
  gRNA
aacaucaauccuaugcauug

SEQ ID NO: 138134 - RNA, 20 nt, Artificial Sequence
  mmSKRIPTE0008913_Tnfsf15_3
  gRNA
gagccauucauggauagcgc

SEQ ID NO: 138135 - RNA, 20 nt, Artificial Sequence
  mmSKRIPTE0008914_Tnfsf15_4
  gRNA
gugucaugguagaugccaca

SEQ ID NO: 138136 - RNA, 20 nt, Artificial Sequence
  mmSKRIPTE0008915_Tnfsf15_5
  gRNA
ucuccaucguuguccaguau

SEQ ID NO: 138137 - RNA, 20 nt, Artificial Sequence
  mmSKRIPTE0008916_Tnfsf15_6
  gRNA
ucugagccuagguccucgcu

SEQ ID NO: 138138 - RNA, 20 nt, Artificial Sequence
  mmSKRIPTE0008917_Tnfsf15_7
  gRNA
agccugcccgccuacuaaca

SEQ ID NO: 138139 - RNA, 20 nt, Artificial Sequence
  mmSKRIPTE0008918_Tnfsf15_8
  gRNA
acucccagaucacauuccga

SEQ ID NO: 138140 - RNA, 20 nt, Artificial Sequence
  mmSKRIPTE0008919_Tnfsf15_9
  gRNA
ggagggugcuaaguccugcg

SEQ ID NO: 138141 - RNA, 20 nt, Artificial Sequence
  mmSKRIPTE0008920_Irf5_1
  gRNA
cguagacugauauagcaaug

SEQ ID NO: 138142 - RNA, 20 nt, Artificial Sequence
  mmSKRIPTE0008921_Irf5_2
  gRNA
ucuccccuaacagaacucac

SEQ ID NO: 138143 - RNA, 20 nt, Artificial Sequence
  mmSKRIPTE0008922_Irf5_3
  gRNA
uacccuggcgccaugccacg

SEQ ID NO: 138144 - RNA, 20 nt, Artificial Sequence
  mmSKRIPTE0008923_Irf5_4
  gRNA
acagcuacucagcagccggg

SEQ ID NO: 138145 - RNA, 20 nt, Artificial Sequence
  mmSKRIPTE0008924_Irf5_5
  gRNA
cagggccacauuauaccugu

SEQ ID NO: 138146 - RNA, 20 nt, Artificial Sequence
  mmSKRIPTE0008925_Irf5_6
  gRNA
agugcgcuucccuagcccag

SEQ ID NO: 138147 - RNA, 20 nt, Artificial Sequence
  mmSKRIPTE0008926_Irf5_7
  gRNA
agggcuucagccucacacgg

SEQ ID NO: 138148 - RNA, 20 nt, Artificial Sequence
  mmSKRIPTE0008927_Irf5_8
  gRNA
ucagccguacaagaucuacg

SEQ ID NO: 138149 - RNA, 20 nt, Artificial Sequence
  mmSKRIPTE0008928_Irf5_9
  gRNA
ugguucugaaaggaacggag

SEQ ID NO: 138150 - RNA, 20 nt, Artificial Sequence
  mmSKRIPTE0008929_Aplf_1
  gRNA
cuuaggaaacuuaagccucg

SEQ ID NO: 138151 - RNA, 20 nt, Artificial Sequence
  mmSKRIPTE0008930_Aplf_2
  gRNA
ggcacccagaguuaggagcg

SEQ ID NO: 138152 - RNA, 20 nt, Artificial Sequence
  mmSKRIPTE0008931_Aplf_3
  gRNA
augcagucuguacuccggaa

SEQ ID NO: 138153 - RNA, 20 nt, Artificial Sequence
  mmSKRIPTE0008932_Aplf_4
  gRNA
acucagccgggucauccaag

SEQ ID NO: 138154 - RNA, 20 nt, Artificial Sequence
  mmSKRIPTE0008933_Aplf_5
  gRNA
uagauaaggaugucauccag

SEQ ID NO: 138155 - RNA, 20 nt, Artificial Sequence
  mmSKRIPTE0008934_Aplf_6
  gRNA
auacucgccugaugucauca

SEQ ID NO: 138156 - RNA, 20 nt, Artificial Sequence
  mmSKRIPTE0008935_Aplf_7
  gRNA
gcccaagcacgaaucaaccu

SEQ ID NO: 138157 - RNA, 20 nt, Artificial Sequence
  mmSKRIPTE0008936_Aplf_8
  gRNA
ugucagcggaacaagacccu

SEQ ID NO: 138158 - RNA, 20 nt, Artificial Sequence
  mmSKRIPTE0008937_Aplf_9
  gRNA
gaccuauuagagcuauacaa

SEQ ID NO: 138159 - RNA, 20 nt, Artificial Sequence
  mmSKRIPTE0008938_H2-Q10_1
  gRNA
ggacuuuauaaccaguggcg

SEQ ID NO: 138160 - RNA, 20 nt, Artificial Sequence
  mmSKRIPTE0008939_H2-Q10_2
  gRNA
uggaggggucgugaccuccg

SEQ ID NO: 138161 - RNA, 20 nt, Artificial Sequence
  mmSKRIPTE0008940_H2-Q10_3
  gRNA
uaaccgacaauaaugaaccg

SEQ ID NO: 138162 - RNA, 20 nt, Artificial Sequence
  mmSKRIPTE0008941_H2-Q10_4
  gRNA
cugggccaggucauucggcu

SEQ ID NO: 138163 - RNA, 20 nt, Artificial Sequence
  mmSKRIPTE0008942_H2-Q10_5
  gRNA
gauuaucacccgacgcaagu

SEQ ID NO: 138164 - RNA, 20 nt, Artificial Sequence
  mmSKRIPTE0008943_H2-Q10_6
  gRNA
caggaacgcgccacucaugg

SEQ ID NO: 138165 - RNA, 20 nt, Artificial Sequence
  mmSKRIPTE0008944_H2-Q10_7
  gRNA
ggagguuucgaaauaccuca

SEQ ID NO: 138166 - RNA, 20 nt, Artificial Sequence
  mmSKRIPTE0008945_H2-Q10_8
  gRNA
augcguauugcagguacccg

SEQ ID NO: 138167 - RNA, 20 nt, Artificial Sequence
  mmSKRIPTE0008946_H2-Q10_9
  gRNA
cacacauugcugaucugcug

SEQ ID NO: 138168 - RNA, 20 nt, Artificial Sequence
  mmSKRIPTE0008947_H2-M10.3_1
  gRNA
acuaccuaaguauuggaacg

SEQ ID NO: 138169 - RNA, 20 nt, Artificial Sequence
  mmSKRIPTE0008948_H2-M10.3_2
  gRNA
uuuguacacacuccccucga

SEQ ID NO: 138170 - RNA, 20 nt, Artificial Sequence
  mmSKRIPTE0008949_H2-M10.3_3
  gRNA
cguuggggacaaaauccugg

SEQ ID NO: 138171 - RNA, 20 nt, Artificial Sequence
  mmSKRIPTE0008950_H2-M10.3_4
  gRNA
agaaucaggguuguuaggua

SEQ ID NO: 138172 - RNA, 20 nt, Artificial Sequence
  mmSKRIPTE0008951_H2-M10.3_5
  gRNA
ugagccggaagugaccguga

SEQ ID NO: 138173 - RNA, 20 nt, Artificial Sequence
  mmSKRIPTE0008952_H2-M10.3_6
  gRNA
agcacuguucaggcccacag

SEQ ID NO: 138174 - RNA, 20 nt, Artificial Sequence
  mmSKRIPTE0008953_H2-M10.3_7
  gRNA
uugucaugaccucggagcug

SEQ ID NO: 138175 - RNA, 20 nt, Artificial Sequence
  mmSKRIPTE0008954_H2-M10.3_8
  gRNA
ugcaucucuccuaguaaggu

SEQ ID NO: 138176 - RNA, 20 nt, Artificial Sequence
  mmSKRIPTE0008955_H2-M10.3_9
  gRNA
auggaccugaguugcagcag

SEQ ID NO: 138177 - RNA, 20 nt, Artificial Sequence
  mmSKRIPTE0008956_S100a14_1
  gRNA
caguccccaccccuaucaug

SEQ ID NO: 138178 - RNA, 20 nt, Artificial Sequence
  mmSKRIPTE0008957_S100a14_2
  gRNA
ugaaggugaaggcauauguu

SEQ ID NO: 138179 - RNA, 20 nt, Artificial Sequence
  mmSKRIPTE0008958_S100a14_3
  gRNA
gugucggucagccaaugcug

SEQ ID NO: 138180 - RNA, 20 nt, Artificial Sequence
  mmSKRIPTE0008959_S100a14_4
  gRNA
aucacccuguguaggcacaa

SEQ ID NO: 138181 - RNA, 20 nt, Artificial Sequence
  mmSKRIPTE0008960_S100a14_5
  gRNA
aggccuguuacucggagcug

SEQ ID NO: 138182 - RNA, 20 nt, Artificial Sequence
  mmSKRIPTE0008961_S100a14_6
  gRNA
ccuaccagguguccacaaag

SEQ ID NO: 138183 - RNA, 20 nt, Artificial Sequence
  mmSKRIPTE0008962_S100a14_7
  gRNA
cacaccucaugccgguacug

SEQ ID NO: 138184 - RNA, 20 nt, Artificial Sequence
  mmSKRIPTE0008963_S100a14_8
  gRNA
caggaacgaugggacagugu

SEQ ID NO: 138185 - RNA, 20 nt, Artificial Sequence
  mmSKRIPTE0008964_S100a14_9
  gRNA
aaggagauacaacccacaug

SEQ ID NO: 138186 - RNA, 20 nt, Artificial Sequence
  mmSKRIPTE0008965_Runx1_1
  gRNA
ugguggcuuugugacgaccg

SEQ ID NO: 138187 - RNA, 20 nt, Artificial Sequence
  mmSKRIPTE0008966_Runx1_2
  gRNA
uugaccuacagaacaccggu

SEQ ID NO: 138188 - RNA, 20 nt, Artificial Sequence
  mmSKRIPTE0008967_Runx1_3
  gRNA
uagucguguccaucgcucag

SEQ ID NO: 138189 - RNA, 20 nt, Artificial Sequence
  mmSKRIPTE0008968_Runx1_4
  gRNA
ugagaucuaguuacacggau

SEQ ID NO: 138190 - RNA, 20 nt, Artificial Sequence
  mmSKRIPTE0008969_Runx1_5
  gRNA
cauacgaucaguucucagag

SEQ ID NO: 138191 - RNA, 20 nt, Artificial Sequence
  mmSKRIPTE0008970_Runx1_6
  gRNA
accaccuagacgucaaccaa

SEQ ID NO: 138192 - RNA, 20 nt, Artificial Sequence
  mmSKRIPTE0008971_Runx1_7
  gRNA
aaacccugucgcauguucga

SEQ ID NO: 138193 - RNA, 20 nt, Artificial Sequence
  mmSKRIPTE0008972_Runx1_8
  gRNA
gcugagcgccaucgccaucg

SEQ ID NO: 138194 - RNA, 20 nt, Artificial Sequence
  mmSKRIPTE0008973_Runx1_9
  gRNA
gugaaaacacaccugcagcg

SEQ ID NO: 138195 - RNA, 20 nt, Artificial Sequence
  mmSKRIPTE0008974_Ddt_1
  gRNA
cuaaacgucugcgacuucag

SEQ ID NO: 138196 - RNA, 20 nt, Artificial Sequence
  mmSKRIPTE0008975_Ddt_2
  gRNA
ccagugcagacuuaacgcaa

SEQ ID NO: 138197 - RNA, 20 nt, Artificial Sequence
  mmSKRIPTE0008976_Ddt_3
  gRNA
gugagcguuacgauacgacc

SEQ ID NO: 138198 - RNA, 20 nt, Artificial Sequence
  mmSKRIPTE0008977_Ddt_4
  gRNA
aaacccgaagacgugaguga

SEQ ID NO: 138199 - RNA, 20 nt, Artificial Sequence
  mmSKRIPTE0008978_Ddt_5
  gRNA
gauuuaccauccuaucuacc

SEQ ID NO: 138200 - RNA, 20 nt, Artificial Sequence
  mmSKRIPTE0008979_Ddt_6
  gRNA
gcggauaacgauccuuuagg

SEQ ID NO: 138201 - RNA, 20 nt, Artificial Sequence
  mmSKRIPTE0008980_Ddt_7
  gRNA
gcgccaaauucuuaacgugg

SEQ ID NO: 138202 - RNA, 20 nt, Artificial Sequence
  mmSKRIPTE0008981_Ddt_8
  gRNA
gugacggaaacaaagaaccc

SEQ ID NO: 138203 - RNA, 20 nt, Artificial Sequence
  mmSKRIPTE0008982_Ddt_9
  gRNA
ccugacgugacugacuccca

SEQ ID NO: 138204 - RNA, 20 nt, Artificial Sequence
  mmSKRIPTE0008983_Apod_1
  gRNA
uggaauucuccucagcaccg

SEQ ID NO: 138205 - RNA, 20 nt, Artificial Sequence
  mmSKRIPTE0008984_Apod_2
  gRNA
cuucagucaucugaucugag

SEQ ID NO: 138206 - RNA, 20 nt, Artificial Sequence
  mmSKRIPTE0008985_Apod_3
  gRNA
ucuaaaucgaugcugaaacg

SEQ ID NO: 138207 - RNA, 20 nt, Artificial Sequence
  mmSKRIPTE0008986_Apod_4
  gRNA
agcaaaucucuucccacucg

SEQ ID NO: 138208 - RNA, 20 nt, Artificial Sequence
  mmSKRIPTE0008987_Apod_5
  gRNA
uugcacuugggguaaccgau

SEQ ID NO: 138209 - RNA, 20 nt, Artificial Sequence
  mmSKRIPTE0008988_Apod_6
  gRNA
ugucacguucuauuccuaag

SEQ ID NO: 138210 - RNA, 20 nt, Artificial Sequence
  mmSKRIPTE0008989_Apod_7
  gRNA
gaaggaacuggauaccuaca

SEQ ID NO: 138211 - RNA, 20 nt, Artificial Sequence
  mmSKRIPTE0008990_Apod_8
  gRNA
aaccucaugaggaacgacca

SEQ ID NO: 138212 - RNA, 20 nt, Artificial Sequence
  mmSKRIPTE0008991_Apod_9
  gRNA
uauagugcaagagucauggu

SEQ ID NO: 138213 - RNA, 20 nt, Artificial Sequence
  mmSKRIPTE0008992_H2-T24_1
  gRNA
aaggagaacccaaggaaucg

SEQ ID NO: 138214 - RNA, 20 nt, Artificial Sequence
  mmSKRIPTE0008993_H2-T24_2
  gRNA
uagagacuauuacaccaccg

SEQ ID NO: 138215 - RNA, 20 nt, Artificial Sequence
  mmSKRIPTE0008994_H2-T24_3
  gRNA
acccgcuacaaaacucaggu

SEQ ID NO: 138216 - RNA, 20 nt, Artificial Sequence
  mmSKRIPTE0008995_H2-T24_4
  gRNA
ccuagcauauacuccugucg

SEQ ID NO: 138217 - RNA, 20 nt, Artificial Sequence
  mmSKRIPTE0008996_H2-T24_5
  gRNA
cuaaagaaaacgucacccug

SEQ ID NO: 138218 - RNA, 20 nt, Artificial Sequence
  mmSKRIPTE0008997_H2-T24_6
  gRNA
uuagugugagguaccgagug

SEQ ID NO: 138219 - RNA, 20 nt, Artificial Sequence
  mmSKRIPTE0008998_H2-T24_7
  gRNA
cuacgacagcaggagcauga

SEQ ID NO: 138220 - RNA, 20 nt, Artificial Sequence
  mmSKRIPTE0008999_H2-T24_8
  gRNA
agccuguuaacagauaaggc

SEQ ID NO: 138221 - RNA, 20 nt, Artificial Sequence
  mmSKRIPTE0009000_H2-T24_9
  gRNA
guucacacucuagauaaccu

SEQ ID NO: 138222 - RNA, 20 nt, Artificial Sequence
  mmSKRIPTE0009001_Il1f10_1
  gRNA
ccgaggccuagaccgcucca

SEQ ID NO: 138223 - RNA, 20 nt, Artificial Sequence
  mmSKRIPTE0009002_Il1f10_2
  gRNA
uuaacgaucgcucaaucaag

SEQ ID NO: 138224 - RNA, 20 nt, Artificial Sequence
  mmSKRIPTE0009003_Il1f10_3
  gRNA
aacaucgaggaccuauacaa

SEQ ID NO: 138225 - RNA, 20 nt, Artificial Sequence
  mmSKRIPTE0009004_Il1f10_4
  gRNA
uaguccaggugaucuuccgg

SEQ ID NO: 138226 - RNA, 20 nt, Artificial Sequence
  mmSKRIPTE0009005_Il1f10_5
  gRNA
uagggguacggaacagcuug

SEQ ID NO: 138227 - RNA, 20 nt, Artificial Sequence
  mmSKRIPTE0009006_Il1f10_6
  gRNA
gaaauggacaaugaucccug

SEQ ID NO: 138228 - RNA, 20 nt, Artificial Sequence
  mmSKRIPTE0009007_Il1f10_7
  gRNA
ccuaggcucaggauuaucag

SEQ ID NO: 138229 - RNA, 20 nt, Artificial Sequence
  mmSKRIPTE0009008_Il1f10_8
  gRNA
aaggcuuuguacacacggaa

SEQ ID NO: 138230 - RNA, 20 nt, Artificial Sequence
  mmSKRIPTE0009009_Il1f10_9
  gRNA
gaauggaacaacuguaagag

SEQ ID NO: 138231 - RNA, 20 nt, Artificial Sequence
  mmSKRIPTE0009010_Il1a_1
  gRNA
gauaguaucauaugucgggg

SEQ ID NO: 138232 - RNA, 20 nt, Artificial Sequence
  mmSKRIPTE0009011_Il1a_2
  gRNA
ucugccugauaccggccaga

SEQ ID NO: 138233 - RNA, 20 nt, Artificial Sequence
  mmSKRIPTE0009012_Il1a_3
  gRNA
accuagaaaacccugcugcg

SEQ ID NO: 138234 - RNA, 20 nt, Artificial Sequence
  mmSKRIPTE0009013_Il1a_4
  gRNA
ccaauaguacaaccccaggu

SEQ ID NO: 138235 - RNA, 20 nt, Artificial Sequence
  mmSKRIPTE0009014_Il1a_5
  gRNA
uggaggguagcuaauccaag

SEQ ID NO: 138236 - RNA, 20 nt, Artificial Sequence
  mmSKRIPTE0009015_Il1a_6
  gRNA
aaggcgguggcagcuagcag

SEQ ID NO: 138237 - RNA, 20 nt, Artificial Sequence
  mmSKRIPTE0009016_Il1a_7
  gRNA
uucugguaggugaacuagug

SEQ ID NO: 138238 - RNA, 20 nt, Artificial Sequence
  mmSKRIPTE0009017_Il1a_8
  gRNA
auguaugccuacucgucggg

SEQ ID NO: 138239 - RNA, 20 nt, Artificial Sequence
  mmSKRIPTE0009018_Il1a_9
  gRNA
aaaaaccauagccuuacaca

SEQ ID NO: 138240 - RNA, 20 nt, Artificial Sequence
  mmSKRIPTE0009019_Vucn1_1
  gRNA
cuguaugaauucaagccccg

SEQ ID NO: 138241 - RNA, 20 nt, Artificial Sequence
  mmSKRIPTE0009020_Vucn1_2
  gRNA
ggagggugaucaucauucua

SEQ ID NO: 138242 - RNA, 20 nt, Artificial Sequence
  mmSKRIPTE0009021_Vucn1_3
  gRNA
uacgcugcgaggcuccucgg

SEQ ID NO: 138243 - RNA, 20 nt, Artificial Sequence
  mmSKRIPTE0009022_Vucn1_4
  gRNA
gccaccuccgaaucucggag

SEQ ID NO: 138244 - RNA, 20 nt, Artificial Sequence
  mmSKRIPTE0009023_Vucn1_5
  gRNA
acauggcugcccaaguacca

SEQ ID NO: 138245 - RNA, 20 nt, Artificial Sequence
  mmSKRIPTE0009024_Vucn1_6
  gRNA
cguugcugguccaacaggug

SEQ ID NO: 138246 - RNA, 20 nt, Artificial Sequence
  mmSKRIPTE0009025_Vucn1_7
  gRNA
aaccccuagaagucucugca

SEQ ID NO: 138247 - RNA, 20 nt, Artificial Sequence
  mmSKRIPTE0009026_Vucn1_8
  gRNA
cgaggguuaguugcauaagu

SEQ ID NO: 138248 - RNA, 20 nt, Artificial Sequence
  mmSKRIPTE0009027_Vucn1_9
  gRNA
uacgggagauggacgcagug

SEQ ID NO: 138249 - RNA, 20 nt, Artificial Sequence
  mmSKRIPTE0009028_Nras_1
  gRNA
gacgacuagagucuugcagc

SEQ ID NO: 138250 - RNA, 20 nt, Artificial Sequence
  mmSKRIPTE0009029_Nras_2
  gRNA
accaaauucagcauuccuag

SEQ ID NO: 138251 - RNA, 20 nt, Artificial Sequence
  mmSKRIPTE0009030_Nras_3
  gRNA
ggcgccuagugauuacguag

SEQ ID NO: 138252 - RNA, 20 nt, Artificial Sequence
  mmSKRIPTE0009031_Nras_4
  gRNA
aggcacccauucgauacacg

SEQ ID NO: 138253 - RNA, 20 nt, Artificial Sequence
  mmSKRIPTE0009032_Nras_5
  gRNA
gauguuugauugaucaagug

SEQ ID NO: 138254 - RNA, 20 nt, Artificial Sequence
  mmSKRIPTE0009033_Nras_6
  gRNA
gcugaguaauaguagcugga

SEQ ID NO: 138255 - RNA, 20 nt, Artificial Sequence
  mmSKRIPTE0009034_Nras_7
  gRNA
ugugcucaguaacugagucg

SEQ ID NO: 138256 - RNA, 20 nt, Artificial Sequence
  mmSKRIPTE0009035_Nras_8
  gRNA
gccaugaacagcccccgcca

SEQ ID NO: 138257 - RNA, 20 nt, Artificial Sequence
  mmSKRIPTE0009036_Nras_9
  gRNA
auuaaccucuacagguacug

SEQ ID NO: 138258 - RNA, 20 nt, Artificial Sequence
  mmSKRIPTE0009037_Mapk3_1
  gRNA
aggcccucgcaccuagaaug

SEQ ID NO: 138259 - RNA, 20 nt, Artificial Sequence
  mmSKRIPTE0009038_Mapk3_2
  gRNA
guacuacgauccgacagaug

SEQ ID NO: 138260 - RNA, 20 nt, Artificial Sequence
  mmSKRIPTE0009039_Mapk3_3
  gRNA
ucgcccaguagggaaacuga

SEQ ID NO: 138261 - RNA, 20 nt, Artificial Sequence
  mmSKRIPTE0009040_Mapk3_4
  gRNA
ccuggucugucgcagccaag

SEQ ID NO: 138262 - RNA, 20 nt, Artificial Sequence
  mmSKRIPTE0009041_Mapk3_5
  gRNA
cgggguaggcuaaaacccag

SEQ ID NO: 138263 - RNA, 20 nt, Artificial Sequence
  mmSKRIPTE0009042_Mapk3_6
  gRNA
cccacugggguagcgacgaa

SEQ ID NO: 138264 - RNA, 20 nt, Artificial Sequence
  mmSKRIPTE0009043_Mapk3_7
  gRNA
uccuacuccccccgacgugg

SEQ ID NO: 138265 - RNA, 20 nt, Artificial Sequence
  mmSKRIPTE0009044_Mapk3_8
  gRNA
cucagguauuccuuccagcg

SEQ ID NO: 138266 - RNA, 20 nt, Artificial Sequence
  mmSKRIPTE0009045_Mapk3_9
  gRNA
gagaguuucccaugucugcg

SEQ ID NO: 138267 - RNA, 20 nt, Artificial Sequence
  mmSKRIPTE0009046_Cd209e_1
  gRNA
auccggguacugguaaacca

SEQ ID NO: 138268 - RNA, 20 nt, Artificial Sequence
  mmSKRIPTE0009047_Cd209e_2
  gRNA
gagcuaccuaacccuagaca

SEQ ID NO: 138269 - RNA, 20 nt, Artificial Sequence
  mmSKRIPTE0009048_Cd209e_3
  gRNA
aaacuccuaacgcauaauug

SEQ ID NO: 138270 - RNA, 20 nt, Artificial Sequence
  mmSKRIPTE0009049_Cd209e_4
  gRNA
ugaaaguccacuccccaacu

SEQ ID NO: 138271 - RNA, 20 nt, Artificial Sequence
  mmSKRIPTE0009050_Cd209e_5
  gRNA
cuaagcaggaccaggcacca

SEQ ID NO: 138272 - RNA, 20 nt, Artificial Sequence
  mmSKRIPTE0009051_Cd209e_6
  gRNA
gcuuuggucagaaccuaggu

SEQ ID NO: 138273 - RNA, 20 nt, Artificial Sequence
  mmSKRIPTE0009052_Cd209e_7
  gRNA
agcacuauagugacuaacaa

SEQ ID NO: 138274 - RNA, 20 nt, Artificial Sequence
  mmSKRIPTE0009053_Cd209e_8
  gRNA
agcaugguuaguuuacuacc

SEQ ID NO: 138275 - RNA, 20 nt, Artificial Sequence
  mmSKRIPTE0009054_Cd209e_9
  gRNA
aagaguagcugcuaggaacg

SEQ ID NO: 138276 - RNA, 20 nt, Artificial Sequence
  mmSKRIPTE0009055_Sele_1
  gRNA
aagugcggauuccgaaccag

SEQ ID NO: 138277 - RNA, 20 nt, Artificial Sequence
  mmSKRIPTE0009056_Sele_2
  gRNA
aagcauguaccugaacacgu

SEQ ID NO: 138278 - RNA, 20 nt, Artificial Sequence
  mmSKRIPTE0009057_Sele_3
  gRNA
agaggacguacaccgcacgg

SEQ ID NO: 138279 - RNA, 20 nt, Artificial Sequence
  mmSKRIPTE0009058_Sele_4
  gRNA
gacaugcacguuugacugug

SEQ ID NO: 138280 - RNA, 20 nt, Artificial Sequence
  mmSKRIPTE0009059_Sele_5
  gRNA
auuccaauccaguaguaacu

SEQ ID NO: 138281 - RNA, 20 nt, Artificial Sequence
  mmSKRIPTE0009060_Sele_6
  gRNA
gagacaguauaagcaacacu

SEQ ID NO: 138282 - RNA, 20 nt, Artificial Sequence
  mmSKRIPTE0009061_Sele_7
  gRNA
guuauacccauugaacccua

SEQ ID NO: 138283 - RNA, 20 nt, Artificial Sequence
  mmSKRIPTE0009062_Sele_8
  gRNA
agcuucacauucaaccacug

SEQ ID NO: 138284 - RNA, 20 nt, Artificial Sequence
  mmSKRIPTE0009063_Sele_9
  gRNA
ggaacauuuccugauaccgu

SEQ ID NO: 138285 - RNA, 20 nt, Artificial Sequence
  mmSKRIPTE0009064_Frk_1
  gRNA
accagguacgagaaugucga

SEQ ID NO: 138286 - RNA, 20 nt, Artificial Sequence
  mmSKRIPTE0009065_Frk_2
  gRNA
uuaccaagcacguacugcag

SEQ ID NO: 138287 - RNA, 20 nt, Artificial Sequence
  mmSKRIPTE0009066_Frk_3
  gRNA
uccuccgccacguaauugga

SEQ ID NO: 138288 - RNA, 20 nt, Artificial Sequence
  mmSKRIPTE0009067_Frk_4
  gRNA
gucuuggacacuucgcauga

SEQ ID NO: 138289 - RNA, 20 nt, Artificial Sequence
  mmSKRIPTE0009068_Frk_5
  gRNA
gaucgguccaguguauggaa

SEQ ID NO: 138290 - RNA, 20 nt, Artificial Sequence
  mmSKRIPTE0009069_Frk_6
  gRNA
aauucauaugccaaucacac

SEQ ID NO: 138291 - RNA, 20 nt, Artificial Sequence
  mmSKRIPTE0009070_Frk_7
  gRNA
gaggagagauccgaagcggg

SEQ ID NO: 138292 - RNA, 20 nt, Artificial Sequence
  mmSKRIPTE0009071_Frk_8
  gRNA
acacagcccgucacuuguug

SEQ ID NO: 138293 - RNA, 20 nt, Artificial Sequence
  mmSKRIPTE0009072_Frk_9
  gRNA
uuaagucaucagacucacau

SEQ ID NO: 138294 - RNA, 20 nt, Artificial Sequence
  mmSKRIPTE0009073_Adora2a_1
  gRNA
uaucucccgcuaauaaagcu

SEQ ID NO: 138295 - RNA, 20 nt, Artificial Sequence
  mmSKRIPTE0009074_Adora2a_2
  gRNA
uagggccccgaguuagguca

SEQ ID NO: 138296 - RNA, 20 nt, Artificial Sequence
  mmSKRIPTE0009075_Adora2a_3
  gRNA
cugcuacugaggcuagaggg

SEQ ID NO: 138297 - RNA, 20 nt, Artificial Sequence
  mmSKRIPTE0009076_Adora2a_4
  gRNA
auuagagacccgaugaacca

SEQ ID NO: 138298 - RNA, 20 nt, Artificial Sequence
  mmSKRIPTE0009077_Adora2a_5
  gRNA
aaccacucggcccaacacau

SEQ ID NO: 138299 - RNA, 20 nt, Artificial Sequence
  mmSKRIPTE0009078_Adora2a_6
  gRNA
gugcuccccacucuggacgg

SEQ ID NO: 138300 - RNA, 20 nt, Artificial Sequence
  mmSKRIPTE0009079_Adora2a_7
  gRNA
gcucucccugggaacgcucg

SEQ ID NO: 138301 - RNA, 20 nt, Artificial Sequence
  mmSKRIPTE0009080_Adora2a_8
  gRNA
cugcagauugacagucccgg

SEQ ID NO: 138302 - RNA, 20 nt, Artificial Sequence
  mmSKRIPTE0009081_Adora2a_9
  gRNA
ugagacgugagcccacacuc

SEQ ID NO: 138303 - RNA, 20 nt, Artificial Sequence
  mmSKRIPTE0009082_Ighv1-78_1
  gRNA
gaugugcagaaagauacgcu

SEQ ID NO: 138304 - RNA, 20 nt, Artificial Sequence
  mmSKRIPTE0009083_Ighv1-78_2
  gRNA
gcaacagucugacgcugagu

SEQ ID NO: 138305 - RNA, 20 nt, Artificial Sequence
  mmSKRIPTE0009084_Ighv1-78_3
  gRNA
gugaauaguauggucaguga

SEQ ID NO: 138306 - RNA, 20 nt, Artificial Sequence
  mmSKRIPTE0009085_Ighv1-78_4
  gRNA
ggugacaaagauauccacuc

SEQ ID NO: 138307 - RNA, 20 nt, Artificial Sequence
  mmSKRIPTE0009086_Ighv1-78_5
  gRNA
cacugacuguaacaauggaa

SEQ ID NO: 138308 - RNA, 20 nt, Artificial Sequence
  mmSKRIPTE0009087_Ighv1-78_6
  gRNA
ccaaaucuaaaguggaguca

SEQ ID NO: 138309 - RNA, 20 nt, Artificial Sequence
  mmSKRIPTE0009088_Ighv1-78_7
  gRNA
ggauauauuuauccuagaga

SEQ ID NO: 138310 - RNA, 20 nt, Artificial Sequence
  mmSKRIPTE0009089_Naip6_1
  gRNA
accaaagcaucaacacccgc

SEQ ID NO: 138311 - RNA, 20 nt, Artificial Sequence
  mmSKRIPTE0009090_Naip6_2
  gRNA
caguauauucaagacuacga

SEQ ID NO: 138312 - RNA, 20 nt, Artificial Sequence
  mmSKRIPTE0009091_Naip6_3
  gRNA
ucaaaggugcucagaaucgg

SEQ ID NO: 138313 - RNA, 20 nt, Artificial Sequence
  mmSKRIPTE0009092_Naip6_4
  gRNA
ucugcuaacaggccaagcac

SEQ ID NO: 138314 - RNA, 20 nt, Artificial Sequence
  mmSKRIPTE0009093_Naip6_5
  gRNA
gaggacagcgauuuaguaca

SEQ ID NO: 138315 - RNA, 20 nt, Artificial Sequence
  mmSKRIPTE0009094_Naip6_6
  gRNA
aguacaucuccuaugacaca

SEQ ID NO: 138316 - RNA, 20 nt, Artificial Sequence
  mmSKRIPTE0009095_Naip6_7
  gRNA
ggagaggucagacucuguag

SEQ ID NO: 138317 - RNA, 20 nt, Artificial Sequence
  mmSKRIPTE0009096_Naip6_8
  gRNA
cagguaagacgugggcagug

SEQ ID NO: 138318 - RNA, 20 nt, Artificial Sequence
  mmSKRIPTE0009097_Naip6_9
  gRNA
auaaugaugugggagaguca

SEQ ID NO: 138319 - RNA, 20 nt, Artificial Sequence
  mmSKRIPTE0009098_Cdkn1a_1
  gRNA
caucucagggccgaaaacgg

SEQ ID NO: 138320 - RNA, 20 nt, Artificial Sequence
  mmSKRIPTE0009099_Cdkn1a_2
  gRNA
guggaacuuugacuucguca

SEQ ID NO: 138321 - RNA, 20 nt, Artificial Sequence
  mmSKRIPTE0009100_Cdkn1a_3
  gRNA
ggacaucacccgugaccuug

SEQ ID NO: 138322 - RNA, 20 nt, Artificial Sequence
  mmSKRIPTE0009101_Cdkn1a_4
  gRNA
ccuaaauuaguaggacggua

SEQ ID NO: 138323 - RNA, 20 nt, Artificial Sequence
  mmSKRIPTE0009102_Cdkn1a_5
  gRNA
auguccgaccuguuccgcac

SEQ ID NO: 138324 - RNA, 20 nt, Artificial Sequence
  mmSKRIPTE0009103_Cdkn1a_6
  gRNA
ccacgggaccgaagagacaa

SEQ ID NO: 138325 - RNA, 20 nt, Artificial Sequence
  mmSKRIPTE0009104_Cdkn1a_7
  gRNA
cauaggcgugggaccucgug

SEQ ID NO: 138326 - RNA, 20 nt, Artificial Sequence
  mmSKRIPTE0009105_Cdkn1a_8
  gRNA
gggcucagcgcauugcuacg

SEQ ID NO: 138327 - RNA, 20 nt, Artificial Sequence
  mmSKRIPTE0009106_Cdkn1a_9
  gRNA
gugguggaaaagcaccugca

SEQ ID NO: 138328 - RNA, 20 nt, Artificial Sequence
  mmSKRIPTE0009107_Gbp2_1
  gRNA
ccuucguacguuccucugag

SEQ ID NO: 138329 - RNA, 20 nt, Artificial Sequence
  mmSKRIPTE0009108_Gbp2_2
  gRNA
uaccggagaaagucuaaaug

SEQ ID NO: 138330 - RNA, 20 nt, Artificial Sequence
  mmSKRIPTE0009109_Gbp2_3
  gRNA
aauuuccugaugcacagucg

SEQ ID NO: 138331 - RNA, 20 nt, Artificial Sequence
  mmSKRIPTE0009110_Gbp2_4
  gRNA
uacaggagaaacguauggcu

SEQ ID NO: 138332 - RNA, 20 nt, Artificial Sequence
  mmSKRIPTE0009111_Gbp2_5
  gRNA
aaaugucaucucugcccggu

SEQ ID NO: 138333 - RNA, 20 nt, Artificial Sequence
  mmSKRIPTE0009112_Gbp2_6
  gRNA
caagaaguuccacugguggu

SEQ ID NO: 138334 - RNA, 20 nt, Artificial Sequence
  mmSKRIPTE0009113_Gbp2_7
  gRNA
uuauuaaccaugaagaccag

SEQ ID NO: 138335 - RNA, 20 nt, Artificial Sequence
  mmSKRIPTE0009114_Gbp2_8
  gRNA
ugguuuacccuaaccagagg

SEQ ID NO: 138336 - RNA, 20 nt, Artificial Sequence
  mmSKRIPTE0009115_Gbp2_9
  gRNA
ugagagacuugaaaauacga

SEQ ID NO: 138337 - RNA, 20 nt, Artificial Sequence
  mmSKRIPTE0009116_Ceacam1_1
  gRNA
uuauuacagaguguugacgg

SEQ ID NO: 138338 - RNA, 20 nt, Artificial Sequence
  mmSKRIPTE0009117_Ceacam1_2
  gRNA
auaguaauaugaauuucacg

SEQ ID NO: 138339 - RNA, 20 nt, Artificial Sequence
  mmSKRIPTE0009118_Ceacam1_3
  gRNA
uaacucuacccaugacgccg

SEQ ID NO: 138340 - RNA, 20 nt, Artificial Sequence
  mmSKRIPTE0009119_Ceacam1_4
  gRNA
uggguccaagugaggcaucg

SEQ ID NO: 138341 - RNA, 20 nt, Artificial Sequence
  mmSKRIPTE0009120_Ceacam1_5
  gRNA
gugaacuggguaaacgugga

SEQ ID NO: 138342 - RNA, 20 nt, Artificial Sequence
  mmSKRIPTE0009121_Ceacam1_6
  gRNA
uuccaggaagucuggcgggu

SEQ ID NO: 138343 - RNA, 20 nt, Artificial Sequence
  mmSKRIPTE0009122_Ceacam1_7
  gRNA
ccacauugguaauagaugca

SEQ ID NO: 138344 - RNA, 20 nt, Artificial Sequence
  mmSKRIPTE0009123_Ceacam1_8
  gRNA
auucgcauccaucgccaugg

SEQ ID NO: 138345 - RNA, 20 nt, Artificial Sequence
  mmSKRIPTE0009124_Ceacam1_9
  gRNA
agcaugccccaauagcaagg

SEQ ID NO: 138346 - RNA, 20 nt, Artificial Sequence
  mmSKRIPTE0009125_Rab33a_1
  gRNA
ggagggucuaagcaaaggcg

SEQ ID NO: 138347 - RNA, 20 nt, Artificial Sequence
  mmSKRIPTE0009126_Rab33a_2
  gRNA
ggcacauccuagcagcggag

SEQ ID NO: 138348 - RNA, 20 nt, Artificial Sequence
  mmSKRIPTE0009127_Rab33a_3
  gRNA
caauauucgagaauuaccac

SEQ ID NO: 138349 - RNA, 20 nt, Artificial Sequence
  mmSKRIPTE0009128_Rab33a_4
  gRNA
ucuuguaccgugaugccgag

SEQ ID NO: 138350 - RNA, 20 nt, Artificial Sequence
  mmSKRIPTE0009129_Rab33a_5
  gRNA
agaacgcuuccguaaaagca

SEQ ID NO: 138351 - RNA, 20 nt, Artificial Sequence
  mmSKRIPTE0009130_Rab33a_6
  gRNA
ucgcuuugagcgcacuaacg

SEQ ID NO: 138352 - RNA, 20 nt, Artificial Sequence
  mmSKRIPTE0009131_Rab33a_7
  gRNA
uuguguggagcccucgagug

SEQ ID NO: 138353 - RNA, 20 nt, Artificial Sequence
  mmSKRIPTE0009132_Rab33a_8
  gRNA
gcaucgucggagcuggccag

SEQ ID NO: 138354 - RNA, 20 nt, Artificial Sequence
  mmSKRIPTE0009133_Rab33a_9
  gRNA
aauuuguauagauuaucacg

SEQ ID NO: 138355 - RNA, 20 nt, Artificial Sequence
  mmSKRIPTE0009134_Cd40lg_1
  gRNA
acuuccauggcaccgacgag

SEQ ID NO: 138356 - RNA, 20 nt, Artificial Sequence
  mmSKRIPTE0009135_Cd40lg_2
  gRNA
ugccuaaugauuaggccgaa

SEQ ID NO: 138357 - RNA, 20 nt, Artificial Sequence
  mmSKRIPTE0009136_Cd40lg_3
  gRNA
cuauuuauuauguaccccca

SEQ ID NO: 138358 - RNA, 20 nt, Artificial Sequence
  mmSKRIPTE0009137_Cd40lg_4
  gRNA
acaguguacuugacuuacca

SEQ ID NO: 138359 - RNA, 20 nt, Artificial Sequence
  mmSKRIPTE0009138_Cd40lg_5
  gRNA
gccuuaauuagcuaaauugg

SEQ ID NO: 138360 - RNA, 20 nt, Artificial Sequence
  mmSKRIPTE0009139_Cd40lg_6
  gRNA
cuuggccuacuagggccgca

SEQ ID NO: 138361 - RNA, 20 nt, Artificial Sequence
  mmSKRIPTE0009140_Cd40lg_7
  gRNA
ccaaccuucccccagauccg

SEQ ID NO: 138362 - RNA, 20 nt, Artificial Sequence
  mmSKRIPTE0009141_Cd40lg_8
  gRNA
acgcacuuuauggcccucag

SEQ ID NO: 138363 - RNA, 20 nt, Artificial Sequence
  mmSKRIPTE0009142_Cd40lg_9
  gRNA
cauuccaagaucuuagucag

SEQ ID NO: 138364 - RNA, 20 nt, Artificial Sequence
  mmSKRIPTE0009143_Foxj1_1
  gRNA
ggucccccuaguauagacag

SEQ ID NO: 138365 - RNA, 20 nt, Artificial Sequence
  mmSKRIPTE0009144_Foxj1_2
  gRNA
agcucuccgccaugucugcg

SEQ ID NO: 138366 - RNA, 20 nt, Artificial Sequence
  mmSKRIPTE0009145_Foxj1_3
  gRNA
agaaggucuaaccucaagcu

SEQ ID NO: 138367 - RNA, 20 nt, Artificial Sequence
  mmSKRIPTE0009146_Foxj1_4
  gRNA
ggucgcccacagaaguagug

SEQ ID NO: 138368 - RNA, 20 nt, Artificial Sequence
  mmSKRIPTE0009147_Foxj1_5
  gRNA
aaugagcguuuguuguaccu

SEQ ID NO: 138369 - RNA, 20 nt, Artificial Sequence
  mmSKRIPTE0009148_Foxj1_6
  gRNA
ggagacgcaggaucagacca

SEQ ID NO: 138370 - RNA, 20 nt, Artificial Sequence
  mmSKRIPTE0009149_Foxj1_7
  gRNA
aaggaggcagaaauccggug

SEQ ID NO: 138371 - RNA, 20 nt, Artificial Sequence
  mmSKRIPTE0009150_Foxj1_8
  gRNA
agaggaaagaggcgccuuag

SEQ ID NO: 138372 - RNA, 20 nt, Artificial Sequence
  mmSKRIPTE0009151_Foxj1_9
  gRNA
gccucugaccgugaacaggg

SEQ ID NO: 138373 - RNA, 20 nt, Artificial Sequence
  mmSKRIPTE0009152_Il17d_1
  gRNA
gccucucgacugcauccccg

SEQ ID NO: 138374 - RNA, 20 nt, Artificial Sequence
  mmSKRIPTE0009153_Il17d_2
  gRNA
acaguuuaacaccggagacu

SEQ ID NO: 138375 - RNA, 20 nt, Artificial Sequence
  mmSKRIPTE0009154_Il17d_3
  gRNA
gcacucaagaauccuacuag

SEQ ID NO: 138376 - RNA, 20 nt, Artificial Sequence
  mmSKRIPTE0009155_Il17d_4
  gRNA
ggugacuggccucgacgccu

SEQ ID NO: 138377 - RNA, 20 nt, Artificial Sequence
  mmSKRIPTE0009156_Il17d_5
  gRNA
auaagggcgccgcacacgcg

SEQ ID NO: 138378 - RNA, 20 nt, Artificial Sequence
  mmSKRIPTE0009157_Il17d_6
  gRNA
aguguucggcguacacagag

SEQ ID NO: 138379 - RNA, 20 nt, Artificial Sequence
  mmSKRIPTE0009158_Il17d_7
  gRNA
cggaaagcgagcagggucgu

SEQ ID NO: 138380 - RNA, 20 nt, Artificial Sequence
  mmSKRIPTE0009159_Il17d_8
  gRNA
ccgccaguccacuucuguag

SEQ ID NO: 138381 - RNA, 20 nt, Artificial Sequence
  mmSKRIPTE0009160_Il17d_9
  gRNA
acaggccgagcucagcgucg

SEQ ID NO: 138382 - RNA, 20 nt, Artificial Sequence
  mmSKRIPTE0009161_Ctnnbip1_1
  gRNA
aggacucacggggcaccgag

SEQ ID NO: 138383 - RNA, 20 nt, Artificial Sequence
  mmSKRIPTE0009162_Ctnnbip1_2
  gRNA
agacggggagaagcguuaug

SEQ ID NO: 138384 - RNA, 20 nt, Artificial Sequence
  mmSKRIPTE0009163_Ctnnbip1_3
  gRNA
ucuucccgggugcucccucg

SEQ ID NO: 138385 - RNA, 20 nt, Artificial Sequence
  mmSKRIPTE0009164_Ctnnbip1_4
  gRNA
auggggugcaucacuuacag

SEQ ID NO: 138386 - RNA, 20 nt, Artificial Sequence
  mmSKRIPTE0009165_Ctnnbip1_5
  gRNA
ccacagcacuccaucgacca

SEQ ID NO: 138387 - RNA, 20 nt, Artificial Sequence
  mmSKRIPTE0009166_Ctnnbip1_6
  gRNA
agauggccaagagaucugug

SEQ ID NO: 138388 - RNA, 20 nt, Artificial Sequence
  mmSKRIPTE0009167_Ctnnbip1_7
  gRNA
ugcaaaggguaagaagacgg

SEQ ID NO: 138389 - RNA, 20 nt, Artificial Sequence
  mmSKRIPTE0009168_Ctnnbip1_8
  gRNA
gugacugcuagacacuaacg

SEQ ID NO: 138390 - RNA, 20 nt, Artificial Sequence
  mmSKRIPTE0009169_Ctnnbip1_9
  gRNA
ccugucuggucccagcagcg

SEQ ID NO: 138391 - RNA, 20 nt, Artificial Sequence
  mmSKRIPTE0009170_Hoxa7_1
  gRNA
uggaguuaaauaaauuuacg

SEQ ID NO: 138392 - RNA, 20 nt, Artificial Sequence
  mmSKRIPTE0009171_Hoxa7_2
  gRNA
agagcugaggcgccauagcg

SEQ ID NO: 138393 - RNA, 20 nt, Artificial Sequence
  mmSKRIPTE0009172_Hoxa7_3
  gRNA
ugaugagugagggaucccgg

SEQ ID NO: 138394 - RNA, 20 nt, Artificial Sequence
  mmSKRIPTE0009173_Hoxa7_4
  gRNA
augugggcggucacgugccg

SEQ ID NO: 138395 - RNA, 20 nt, Artificial Sequence
  mmSKRIPTE0009174_Hoxa7_5
  gRNA
gguaggcucaguggucggcg

SEQ ID NO: 138396 - RNA, 20 nt, Artificial Sequence
  mmSKRIPTE0009175_Hoxa7_6
  gRNA
auuguauaagcccggcacag

SEQ ID NO: 138397 - RNA, 20 nt, Artificial Sequence
  mmSKRIPTE0009176_Hoxa7_7
  gRNA
ggccauagccggacgcgaag

SEQ ID NO: 138398 - RNA, 20 nt, Artificial Sequence
  mmSKRIPTE0009177_Hoxa7_8
  gRNA
augagggucgcccacuagca

SEQ ID NO: 138399 - RNA, 20 nt, Artificial Sequence
  mmSKRIPTE0009178_Hoxa7_9
  gRNA
gcuccguccaaaagaaaaug

SEQ ID NO: 138400 - RNA, 20 nt, Artificial Sequence
  mmSKRIPTE0009179_Clec2d_1
  gRNA
gaucccguuguuguucaggu

SEQ ID NO: 138401 - RNA, 20 nt, Artificial Sequence
  mmSKRIPTE0009180_Clec2d_2
  gRNA
uaacuaaaggccucccaccg

SEQ ID NO: 138402 - RNA, 20 nt, Artificial Sequence
  mmSKRIPTE0009181_Clec2d_3
  gRNA
acacacgcuugguuggcuca

SEQ ID NO: 138403 - RNA, 20 nt, Artificial Sequence
  mmSKRIPTE0009182_Clec2d_4
  gRNA
ugugggacuaagcauaggua

SEQ ID NO: 138404 - RNA, 20 nt, Artificial Sequence
  mmSKRIPTE0009183_Clec2d_5
  gRNA
uuguggcuaugggagaugaa

SEQ ID NO: 138405 - RNA, 20 nt, Artificial Sequence
  mmSKRIPTE0009184_Clec2d_6
  gRNA
cugagaggcacaaauacgug

SEQ ID NO: 138406 - RNA, 20 nt, Artificial Sequence
  mmSKRIPTE0009185_Clec2d_7
  gRNA
cucuagaggaaucuguggag

SEQ ID NO: 138407 - RNA, 20 nt, Artificial Sequence
  mmSKRIPTE0009186_Clec2d_8
  gRNA
gggcgaauguccaguuacuu

SEQ ID NO: 138408 - RNA, 20 nt, Artificial Sequence
  mmSKRIPTE0009187_Clec2d_9
  gRNA
aaucuuuccucuccccggau

SEQ ID NO: 138409 - RNA, 20 nt, Artificial Sequence
  mmSKRIPTE0009188_Tyrobp_1
  gRNA
ugugacguccaaccaaguga

SEQ ID NO: 138410 - RNA, 20 nt, Artificial Sequence
  mmSKRIPTE0009189_Tyrobp_2
  gRNA
cguuggaauacagauccaca

SEQ ID NO: 138411 - RNA, 20 nt, Artificial Sequence
  mmSKRIPTE0009190_Tyrobp_3
  gRNA
agucccguacaggcccagag

SEQ ID NO: 138412 - RNA, 20 nt, Artificial Sequence
  mmSKRIPTE0009191_Tyrobp_4
  gRNA
gggacacagguuaacaauca

SEQ ID NO: 138413 - RNA, 20 nt, Artificial Sequence
  mmSKRIPTE0009192_Tyrobp_5
  gRNA
caaugucagauaucucaggg

SEQ ID NO: 138414 - RNA, 20 nt, Artificial Sequence
  mmSKRIPTE0009193_Tyrobp_6
  gRNA
gcugacgaauuggguaacag

SEQ ID NO: 138415 - RNA, 20 nt, Artificial Sequence
  mmSKRIPTE0009194_Tyrobp_7
  gRNA
uccccccuacugauacuacc

SEQ ID NO: 138416 - RNA, 20 nt, Artificial Sequence
  mmSKRIPTE0009195_Tyrobp_8
  gRNA
uguucagcccauugggaccg

SEQ ID NO: 138417 - RNA, 20 nt, Artificial Sequence
  mmSKRIPTE0009196_Tyrobp_9
  gRNA
ggaggaggaacguauagaca

SEQ ID NO: 138418 - RNA, 20 nt, Artificial Sequence
  mmSKRIPTE0009197_Cd1d1_1
  gRNA
gcucccggacugguacacaa

SEQ ID NO: 138419 - RNA, 20 nt, Artificial Sequence
  mmSKRIPTE0009198_Cd1d1_2
  gRNA
cagagccagcaaaacccgga

SEQ ID NO: 138420 - RNA, 20 nt, Artificial Sequence
  mmSKRIPTE0009199_Cd1d1_3
  gRNA
cuggucccgcacagacagcg

SEQ ID NO: 138421 - RNA, 20 nt, Artificial Sequence
  mmSKRIPTE0009200_Cd1d1_4
  gRNA
cugcccaaacagacgcucug

SEQ ID NO: 138422 - RNA, 20 nt, Artificial Sequence
  mmSKRIPTE0009201_Cd1d1_5
  gRNA
agcgcacacaaucuagagaa

SEQ ID NO: 138423 - RNA, 20 nt, Artificial Sequence
  mmSKRIPTE0009202_Cd1d1_6
  gRNA
uccaacccucaacuaccagg

SEQ ID NO: 138424 - RNA, 20 nt, Artificial Sequence
  mmSKRIPTE0009203_Cd1d1_7
  gRNA
ccaauuaaugauaacuccaa

SEQ ID NO: 138425 - RNA, 20 nt, Artificial Sequence
  mmSKRIPTE0009204_Cd1d1_8
  gRNA
aaaggaaagaacuuagcgag

SEQ ID NO: 138426 - RNA, 20 nt, Artificial Sequence
  mmSKRIPTE0009205_Cd1d1_9
  gRNA
auuuguccguggucuccuag

SEQ ID NO: 138427 - RNA, 20 nt, Artificial Sequence
  mmSKRIPTE0009206_Ifnk_1
  gRNA
cagggaacauccucacuccg

SEQ ID NO: 138428 - RNA, 20 nt, Artificial Sequence
  mmSKRIPTE0009207_Ifnk_2
  gRNA
agacagcaaacauuacacga

SEQ ID NO: 138429 - RNA, 20 nt, Artificial Sequence
  mmSKRIPTE0009208_Ifnk_3
  gRNA
ugccagagaggauauacgau

SEQ ID NO: 138430 - RNA, 20 nt, Artificial Sequence
  mmSKRIPTE0009209_Ifnk_4
  gRNA
ugcauggaagauugucacag

SEQ ID NO: 138431 - RNA, 20 nt, Artificial Sequence
  mmSKRIPTE0009210_Ifnk_5
  gRNA
acacaguucagagauuggau

SEQ ID NO: 138432 - RNA, 20 nt, Artificial Sequence
  mmSKRIPTE0009211_Ifnk_6
  gRNA
cucggaaaaaaagcgccugg

SEQ ID NO: 138433 - RNA, 20 nt, Artificial Sequence
  mmSKRIPTE0009212_Ifnk_7
  gRNA
uggcugugcagugcaugaug

SEQ ID NO: 138434 - RNA, 20 nt, Artificial Sequence
  mmSKRIPTE0009213_Ifnk_8
  gRNA
uagauaugguugucguauca

SEQ ID NO: 138435 - RNA, 20 nt, Artificial Sequence
  mmSKRIPTE0009214_Ifnk_9
  gRNA
ccuaguaaaccugacacaca

SEQ ID NO: 138436 - RNA, 20 nt, Artificial Sequence
  mmSKRIPTE0009215_Gm13288_1
  gRNA
gcaucaauaucaaucucacu

SEQ ID NO: 138437 - RNA, 20 nt, Artificial Sequence
  mmSKRIPTE0009216_Gm13288_2
  gRNA
auaaagcugucuucaacgaa

SEQ ID NO: 138438 - RNA, 20 nt, Artificial Sequence
  mmSKRIPTE0009217_Gm13288_3
  gRNA
aucuugaugaaacaugagau

SEQ ID NO: 138439 - RNA, 20 nt, Artificial Sequence
  mmSKRIPTE0009218_Gm13288_4
  gRNA
cuucacuagaccauuuacaa

SEQ ID NO: 138440 - RNA, 20 nt, Artificial Sequence
  mmSKRIPTE0009219_Gm13288_5
  gRNA
uagcagcuuguauggaaccu

SEQ ID NO: 138441 - RNA, 20 nt, Artificial Sequence
  mmSKRIPTE0009220_Gm13288_6
  gRNA
gacuaggguuuacauaggga

SEQ ID NO: 138442 - RNA, 20 nt, Artificial Sequence
  mmSKRIPTE0009221_Gm13288_7
  gRNA
uuggaacugaggaguuagug

SEQ ID NO: 138443 - RNA, 20 nt, Artificial Sequence
  mmSKRIPTE0009222_Gm13288_8
  gRNA
uaggauagcccacugacacc

SEQ ID NO: 138444 - RNA, 20 nt, Artificial Sequence
  mmSKRIPTE0009223_Gm13288_9
  gRNA
ccugaggccuauagagccag

SEQ ID NO: 138445 - RNA, 20 nt, Artificial Sequence
  mmSKRIPTE0009224_Tnfrsf4_1
  gRNA
uggaugccgguggagccgaa

SEQ ID NO: 138446 - RNA, 20 nt, Artificial Sequence
  mmSKRIPTE0009225_Tnfrsf4_2
  gRNA
cuucaggaccccgauccagg

SEQ ID NO: 138447 - RNA, 20 nt, Artificial Sequence
  mmSKRIPTE0009226_Tnfrsf4_3
  gRNA
cacagguccagaauacgugg

SEQ ID NO: 138448 - RNA, 20 nt, Artificial Sequence
  mmSKRIPTE0009227_Tnfrsf4_4
  gRNA
uacgccugugccaaauacac

SEQ ID NO: 138449 - RNA, 20 nt, Artificial Sequence
  mmSKRIPTE0009228_Tnfrsf4_5
  gRNA
uagcuagcgcauuuccuaug

SEQ ID NO: 138450 - RNA, 20 nt, Artificial Sequence
  mmSKRIPTE0009229_Tnfrsf4_6
  gRNA
acuguggauacacagcaccg

SEQ ID NO: 138451 - RNA, 20 nt, Artificial Sequence
  mmSKRIPTE0009230_Tnfrsf4_7
  gRNA
uccacucagagaccuacacu

SEQ ID NO: 138452 - RNA, 20 nt, Artificial Sequence
  mmSKRIPTE0009231_Tnfrsf4_8
  gRNA
uuagugaucaggauucauug

SEQ ID NO: 138453 - RNA, 20 nt, Artificial Sequence
  mmSKRIPTE0009232_Tnfrsf4_9
  gRNA
ucaugguccuugauucaagg

SEQ ID NO: 138454 - RNA, 20 nt, Artificial Sequence
  mmSKRIPTE0009233_Cxcl15_1
  gRNA
gcaucuucgguaagcuaacg

SEQ ID NO: 138455 - RNA, 20 nt, Artificial Sequence
  mmSKRIPTE0009234_Cxcl15_2
  gRNA
gcuaaguggucagaacgugg

SEQ ID NO: 138456 - RNA, 20 nt, Artificial Sequence
  mmSKRIPTE0009235_Cxcl15_3
  gRNA
gcucaagugaggccguucug

SEQ ID NO: 138457 - RNA, 20 nt, Artificial Sequence
  mmSKRIPTE0009236_Cxcl15_4
  gRNA
caaagaaguauuucacccug

SEQ ID NO: 138458 - RNA, 20 nt, Artificial Sequence
  mmSKRIPTE0009237_Cxcl15_5
  gRNA
gucacagggacggacuguag

SEQ ID NO: 138459 - RNA, 20 nt, Artificial Sequence
  mmSKRIPTE0009238_Cxcl15_6
  gRNA
acuuaggagccaauacagca

SEQ ID NO: 138460 - RNA, 20 nt, Artificial Sequence
  mmSKRIPTE0009239_Cxcl15_7
  gRNA
uaacuauaauaucugcaaca

SEQ ID NO: 138461 - RNA, 20 nt, Artificial Sequence
  mmSKRIPTE0009240_Cxcl15_8
  gRNA
uaaaucagcaaagugucuag

SEQ ID NO: 138462 - RNA, 20 nt, Artificial Sequence
  mmSKRIPTE0009241_Cxcl15_9
  gRNA
agucaggccacagacggaca

SEQ ID NO: 138463 - RNA, 20 nt, Artificial Sequence
  mmSKRIPTE0009242_Fkbp1b_1
  gRNA
guguggugcacuacacaggu

SEQ ID NO: 138464 - RNA, 20 nt, Artificial Sequence
  mmSKRIPTE0009243_Fkbp1b_2
  gRNA
cugcccagguaggcuaagga

SEQ ID NO: 138465 - RNA, 20 nt, Artificial Sequence
  mmSKRIPTE0009244_Fkbp1b_3
  gRNA
gagguguuugacuuucucgg

SEQ ID NO: 138466 - RNA, 20 nt, Artificial Sequence
  mmSKRIPTE0009245_Fkbp1b_4
  gRNA
cugauuccgagguggcuccg

SEQ ID NO: 138467 - RNA, 20 nt, Artificial Sequence
  mmSKRIPTE0009246_Fkbp1b_5
  gRNA
uucugcgcccgcucaccuug

SEQ ID NO: 138468 - RNA, 20 nt, Artificial Sequence
  mmSKRIPTE0009247_Fkbp1b_6
  gRNA
uagcuccauaggccacauca

SEQ ID NO: 138469 - RNA, 20 nt, Artificial Sequence
  mmSKRIPTE0009248_Fkbp1b_7
  gRNA
ucaaagaugcgggcgacagg

SEQ ID NO: 138470 - RNA, 20 nt, Artificial Sequence
  mmSKRIPTE0009249_Fkbp1b_8
  gRNA
cuggagucaggaccugcgcg

SEQ ID NO: 138471 - RNA, 20 nt, Artificial Sequence
  mmSKRIPTE0009250_Fkbp1b_9
  gRNA
aauccuaggaggaaugccug

SEQ ID NO: 138472 - RNA, 20 nt, Artificial Sequence
  mmSKRIPTE0009251_Ighm_1
  gRNA
uaccuguguuguaggccacg

SEQ ID NO: 138473 - RNA, 20 nt, Artificial Sequence
  mmSKRIPTE0009252_Ighm_2
  gRNA
gaccaugcuagcgcucaacc

SEQ ID NO: 138474 - RNA, 20 nt, Artificial Sequence
  mmSKRIPTE0009253_Ighm_3
  gRNA
gaggacuucccuaaucuggg

SEQ ID NO: 138475 - RNA, 20 nt, Artificial Sequence
  mmSKRIPTE0009254_Ighm_4
  gRNA
ccuuccuguaccucauaggg

SEQ ID NO: 138476 - RNA, 20 nt, Artificial Sequence
  mmSKRIPTE0009255_Ighm_5
  gRNA
uuaccaucucugaaaucgac

SEQ ID NO: 138477 - RNA, 20 nt, Artificial Sequence
  mmSKRIPTE0009256_Ighm_6
  gRNA
guaugcaaaauccacuacgg

SEQ ID NO: 138478 - RNA, 20 nt, Artificial Sequence
  mmSKRIPTE0009257_Ighm_7
  gRNA
gggagacagcaacaccugcg

SEQ ID NO: 138479 - RNA, 20 nt, Artificial Sequence
  mmSKRIPTE0009258_Ighm_8
  gRNA
cugccuuaagaguagcaaca

SEQ ID NO: 138480 - RNA, 20 nt, Artificial Sequence
  mmSKRIPTE0009259_Ighm_9
  gRNA
gcuaaaggaugggaagcucg

SEQ ID NO: 138481 - RNA, 20 nt, Artificial Sequence
  mmSKRIPTE0009260_Ifna2_1
  gRNA
ucaucacuaucagcaucacg

SEQ ID NO: 138482 - RNA, 20 nt, Artificial Sequence
  mmSKRIPTE0009261_Ifna2_2
  gRNA
ucuuggcagcaaguugacug

SEQ ID NO: 138483 - RNA, 20 nt, Artificial Sequence
  mmSKRIPTE0009262_Ifna2_3
  gRNA
agaugcaguuucuaguccag

SEQ ID NO: 138484 - RNA, 20 nt, Artificial Sequence
  mmSKRIPTE0009263_Ifna2_4
  gRNA
gcaaaccugucugaugcagc

SEQ ID NO: 138485 - RNA, 20 nt, Artificial Sequence
  mmSKRIPTE0009264_Ifna2_5
  gRNA
auggaacccacaugcgugag

SEQ ID NO: 138486 - RNA, 20 nt, Artificial Sequence
  mmSKRIPTE0009265_Ifna2_6
  gRNA
ggagccuccucaucugugcc

SEQ ID NO: 138487 - RNA, 20 nt, Artificial Sequence
  mmSKRIPTE0009266_Tyk2_1
  gRNA
gagccagcuguauaccggug

SEQ ID NO: 138488 - RNA, 20 nt, Artificial Sequence
  mmSKRIPTE0009267_Tyk2_2
  gRNA
gagugaugccuggaacacgg

SEQ ID NO: 138489 - RNA, 20 nt, Artificial Sequence
  mmSKRIPTE0009268_Tyk2_3
  gRNA
uggucucucucaucaaacgc

SEQ ID NO: 138490 - RNA, 20 nt, Artificial Sequence
  mmSKRIPTE0009269_Tyk2_4
  gRNA
caugugacauagcaccagug

SEQ ID NO: 138491 - RNA, 20 nt, Artificial Sequence
  mmSKRIPTE0009270_Tyk2_5
  gRNA
gcuuaugucaggaccccuag

SEQ ID NO: 138492 - RNA, 20 nt, Artificial Sequence
  mmSKRIPTE0009271_Tyk2_6
  gRNA
gugucccuacccaaccugca

SEQ ID NO: 138493 - RNA, 20 nt, Artificial Sequence
  mmSKRIPTE0009272_Tyk2_7
  gRNA
ucugcgggaccugucuagcg

SEQ ID NO: 138494 - RNA, 20 nt, Artificial Sequence
  mmSKRIPTE0009273_Tyk2_8
  gRNA
gggcauuuagaccauuucag

SEQ ID NO: 138495 - RNA, 20 nt, Artificial Sequence
  mmSKRIPTE0009274_Tyk2_9
  gRNA
gcaugaguucaugaacgaug

SEQ ID NO: 138496 - RNA, 20 nt, Artificial Sequence
  mmSKRIPTE0009275_Ccl2_1
  gRNA
uccacgacaauucaaaaaug

SEQ ID NO: 138497 - RNA, 20 nt, Artificial Sequence
  mmSKRIPTE0009276_Ccl2_2
  gRNA
guagugugaguuacauaccc

SEQ ID NO: 138498 - RNA, 20 nt, Artificial Sequence
  mmSKRIPTE0009277_Ccl2_3
  gRNA
cacuuccuggaaacacccga

SEQ ID NO: 138499 - RNA, 20 nt, Artificial Sequence
  mmSKRIPTE0009278_Ccl2_4
  gRNA
caccuggcugagccaacacg

SEQ ID NO: 138500 - RNA, 20 nt, Artificial Sequence
  mmSKRIPTE0009279_Ccl2_5
  gRNA
agguugggacacauauugug

SEQ ID NO: 138501 - RNA, 20 nt, Artificial Sequence
  mmSKRIPTE0009280_Ccl2_6
  gRNA
gcaucacccuggauaaguga

SEQ ID NO: 138502 - RNA, 20 nt, Artificial Sequence
  mmSKRIPTE0009281_Ccl2_7
  gRNA
gggcuguguagagcucagcg

SEQ ID NO: 138503 - RNA, 20 nt, Artificial Sequence
  mmSKRIPTE0009282_Ccl2_8
  gRNA
gaaaaaccuuuggaccaggg

SEQ ID NO: 138504 - RNA, 20 nt, Artificial Sequence
  mmSKRIPTE0009283_Ccl2_9
  gRNA
aagcaaucuuguaauugggu

SEQ ID NO: 138505 - RNA, 20 nt, Artificial Sequence
  mmSKRIPTE0009284_H2-M10.2_1
  gRNA
ggucagggugauccagcucg

SEQ ID NO: 138506 - RNA, 20 nt, Artificial Sequence
  mmSKRIPTE0009285_H2-M10.2_2
  gRNA
gugaauguaggcgcagcgga

SEQ ID NO: 138507 - RNA, 20 nt, Artificial Sequence
  mmSKRIPTE0009286_H2-M10.2_3
  gRNA
uagccgaccuggaugauccg

SEQ ID NO: 138508 - RNA, 20 nt, Artificial Sequence
  mmSKRIPTE0009287_H2-M10.2_4
  gRNA
ccuaaccagaucacagucug

SEQ ID NO: 138509 - RNA, 20 nt, Artificial Sequence
  mmSKRIPTE0009288_H2-M10.2_5
  gRNA
aaucggcaucugccacauca

SEQ ID NO: 138510 - RNA, 20 nt, Artificial Sequence
  mmSKRIPTE0009289_H2-M10.2_6
  gRNA
guuggggacaaaucccggga

SEQ ID NO: 138511 - RNA, 20 nt, Artificial Sequence
  mmSKRIPTE0009290_H2-M10.2_7
  gRNA
gcuuauugggccaaaccagg

SEQ ID NO: 138512 - RNA, 20 nt, Artificial Sequence
  mmSKRIPTE0009291_H2-M10.2_8
  gRNA
cguuugucagugacaagcgc

SEQ ID NO: 138513 - RNA, 20 nt, Artificial Sequence
  mmSKRIPTE0009292_H2-M10.2_9
  gRNA
agaugggaaaaacuacaccc

SEQ ID NO: 138514 - RNA, 20 nt, Artificial Sequence
  mmSKRIPTE0009293_Adora3_1
  gRNA
auguaggguagaucuuaaca

SEQ ID NO: 138515 - RNA, 20 nt, Artificial Sequence
  mmSKRIPTE0009294_Adora3_2
  gRNA
uuuacugauaccacaugcga

SEQ ID NO: 138516 - RNA, 20 nt, Artificial Sequence
  mmSKRIPTE0009295_Adora3_3
  gRNA
ucagguaacaggguugacga

SEQ ID NO: 138517 - RNA, 20 nt, Artificial Sequence
  mmSKRIPTE0009296_Adora3_4
  gRNA
uaagagagagucauaccgga

SEQ ID NO: 138518 - RNA, 20 nt, Artificial Sequence
  mmSKRIPTE0009297_Adora3_5
  gRNA
aauccaaacugaccacggaa

SEQ ID NO: 138519 - RNA, 20 nt, Artificial Sequence
  mmSKRIPTE0009298_Adora3_6
  gRNA
guuugaguccaaagaaucug

SEQ ID NO: 138520 - RNA, 20 nt, Artificial Sequence
  mmSKRIPTE0009299_Adora3_7
  gRNA
auagugcuacaauugaacgg

SEQ ID NO: 138521 - RNA, 20 nt, Artificial Sequence
  mmSKRIPTE0009300_Adora3_8
  gRNA
uugacucauuucuacgaaag

SEQ ID NO: 138522 - RNA, 20 nt, Artificial Sequence
  mmSKRIPTE0009301_Adora3_9
  gRNA
guucaucauggaguucgcgu

SEQ ID NO: 138523 - RNA, 20 nt, Artificial Sequence
  mmSKRIPTE0009302_Ccl20_1
  gRNA
gaggcgucuguauguacgag

SEQ ID NO: 138524 - RNA, 20 nt, Artificial Sequence
  mmSKRIPTE0009303_Ccl20_2
  gRNA
agaaggcguguucucacccg

SEQ ID NO: 138525 - RNA, 20 nt, Artificial Sequence
  mmSKRIPTE0009304_Ccl20_3
  gRNA
cuaagcgcccccauggauug

SEQ ID NO: 138526 - RNA, 20 nt, Artificial Sequence
  mmSKRIPTE0009305_Ccl20_4
  gRNA
ccauaucuagggguucccug

SEQ ID NO: 138527 - RNA, 20 nt, Artificial Sequence
  mmSKRIPTE0009306_Ccl20_5
  gRNA
ggagcacaggagcacucgca

SEQ ID NO: 138528 - RNA, 20 nt, Artificial Sequence
  mmSKRIPTE0009307_Ccl20_6
  gRNA
cuacuguugagaagguguga

SEQ ID NO: 138529 - RNA, 20 nt, Artificial Sequence
  mmSKRIPTE0009308_Ccl20_7
  gRNA
gaauuggacacagcccaagg

SEQ ID NO: 138530 - RNA, 20 nt, Artificial Sequence
  mmSKRIPTE0009309_Ccl20_8
  gRNA
ccuucaaugauccauaccug

SEQ ID NO: 138531 - RNA, 20 nt, Artificial Sequence
  mmSKRIPTE0009310_Ccl20_9
  gRNA
gaguugauguacucagugcu

SEQ ID NO: 138532 - RNA, 20 nt, Artificial Sequence
  mmSKRIPTE0009311_Mif_1
  gRNA
gggacguagucugacgucag

SEQ ID NO: 138533 - RNA, 20 nt, Artificial Sequence
  mmSKRIPTE0009312_Mif_2
  gRNA
gccuggcucagcuaagcacg

SEQ ID NO: 138534 - RNA, 20 nt, Artificial Sequence
  mmSKRIPTE0009313_Mif_3
  gRNA
uacauaaggcugcauaggag

SEQ ID NO: 138535 - RNA, 20 nt, Artificial Sequence
  mmSKRIPTE0009314_Mif_4
  gRNA
accacuggacuaguuuagag

SEQ ID NO: 138536 - RNA, 20 nt, Artificial Sequence
  mmSKRIPTE0009315_Mif_5
  gRNA
gaagcccaggcucugaacgu

SEQ ID NO: 138537 - RNA, 20 nt, Artificial Sequence
  mmSKRIPTE0009316_Mif_6
  gRNA
acggaggaugcuagauagug

SEQ ID NO: 138538 - RNA, 20 nt, Artificial Sequence
  mmSKRIPTE0009317_Mif_7
  gRNA
ggagcucuccggaagaccug

SEQ ID NO: 138539 - RNA, 20 nt, Artificial Sequence
  mmSKRIPTE0009318_Mif_8
  gRNA
ucagcgcgcugcuucugcag

SEQ ID NO: 138540 - RNA, 20 nt, Artificial Sequence
  mmSKRIPTE0009319_Mif_9
  gRNA
ugcuguaggaaguauuacau

SEQ ID NO: 138541 - RNA, 20 nt, Artificial Sequence
  mmSKRIPTE0009320_Oas1c_1
  gRNA
ugacauguaaugacaacacg

SEQ ID NO: 138542 - RNA, 20 nt, Artificial Sequence
  mmSKRIPTE0009321_Oas1c_2
  gRNA
aaucuggccagcgugcaucg

SEQ ID NO: 138543 - RNA, 20 nt, Artificial Sequence
  mmSKRIPTE0009322_Oas1c_3
  gRNA
ucaauucacuuacagaggug

SEQ ID NO: 138544 - RNA, 20 nt, Artificial Sequence
  mmSKRIPTE0009323_Oas1c_4
  gRNA
uccuagaccugcaaguccag

SEQ ID NO: 138545 - RNA, 20 nt, Artificial Sequence
  mmSKRIPTE0009324_Oas1c_5
  gRNA
auugcagcccgacacccucg

SEQ ID NO: 138546 - RNA, 20 nt, Artificial Sequence
  mmSKRIPTE0009325_Oas1c_6
  gRNA
gcugcucacugucuauguau

SEQ ID NO: 138547 - RNA, 20 nt, Artificial Sequence
  mmSKRIPTE0009326_Oas1c_7
  gRNA
cugccuugggaaugcucgug

SEQ ID NO: 138548 - RNA, 20 nt, Artificial Sequence
  mmSKRIPTE0009327_Oas1c_8
  gRNA
gaaacccagacuagaaucca

SEQ ID NO: 138549 - RNA, 20 nt, Artificial Sequence
  mmSKRIPTE0009328_Oas1c_9
  gRNA
ggagaugccgaguugacaca

SEQ ID NO: 138550 - RNA, 20 nt, Artificial Sequence
  mmSKRIPTE0009329_Il31_1
  gRNA
cuucggugccccaauaucga

SEQ ID NO: 138551 - RNA, 20 nt, Artificial Sequence
  mmSKRIPTE0009330_Il31_2
  gRNA
aucaugcacgugaugcugcu

SEQ ID NO: 138552 - RNA, 20 nt, Artificial Sequence
  mmSKRIPTE0009331_Il31_3
  gRNA
aguuuguuaacgcuccaugg

SEQ ID NO: 138553 - RNA, 20 nt, Artificial Sequence
  mmSKRIPTE0009332_Il31_4
  gRNA
aggcuguuguaacugaagcu

SEQ ID NO: 138554 - RNA, 20 nt, Artificial Sequence
  mmSKRIPTE0009333_Il31_5
  gRNA
uggagccagcgguaccugug

SEQ ID NO: 138555 - RNA, 20 nt, Artificial Sequence
  mmSKRIPTE0009334_Il31_6
  gRNA
ucccgguccaggcugaaaca

SEQ ID NO: 138556 - RNA, 20 nt, Artificial Sequence
  mmSKRIPTE0009335_Il31_7
  gRNA
acccuuuauauauugccugg

SEQ ID NO: 138557 - RNA, 20 nt, Artificial Sequence
  mmSKRIPTE0009336_Il31_8
  gRNA
uguguggaagaucauggcga

SEQ ID NO: 138558 - RNA, 20 nt, Artificial Sequence
  mmSKRIPTE0009337_Il31_9
  gRNA
aggaacaacgaagccuaccc

SEQ ID NO: 138559 - RNA, 20 nt, Artificial Sequence
  mmSKRIPTE0009338_Mill2_1
  gRNA
gcaggucacaguuaccauug

SEQ ID NO: 138560 - RNA, 20 nt, Artificial Sequence
  mmSKRIPTE0009339_Mill2_2
  gRNA
agguaacgaguuccugccug

SEQ ID NO: 138561 - RNA, 20 nt, Artificial Sequence
  mmSKRIPTE0009340_Mill2_3
  gRNA
cugcuccuuagagacucacg

SEQ ID NO: 138562 - RNA, 20 nt, Artificial Sequence
  mmSKRIPTE0009341_Mill2_4
  gRNA
ccagcccgccaugaagugcg

SEQ ID NO: 138563 - RNA, 20 nt, Artificial Sequence
  mmSKRIPTE0009342_Mill2_5
  gRNA
cugcauuagucacauccugg

SEQ ID NO: 138564 - RNA, 20 nt, Artificial Sequence
  mmSKRIPTE0009343_Mill2_6
  gRNA
cccaccccuagguaagugcg

SEQ ID NO: 138565 - RNA, 20 nt, Artificial Sequence
  mmSKRIPTE0009344_Mill2_7
  gRNA
cuagggaagucacaacggag

SEQ ID NO: 138566 - RNA, 20 nt, Artificial Sequence
  mmSKRIPTE0009345_Mill2_8
  gRNA
ccacagcaguacaaucaucu

SEQ ID NO: 138567 - RNA, 20 nt, Artificial Sequence
  mmSKRIPTE0009346_Mill2_9
  gRNA
gaccguuucucaaggaagcg

SEQ ID NO: 138568 - RNA, 20 nt, Artificial Sequence
  mmSKRIPTE0009347_Cxcl17_1
  gRNA
gauguguuucccuccaacag

SEQ ID NO: 138569 - RNA, 20 nt, Artificial Sequence
  mmSKRIPTE0009348_Cxcl17_2
  gRNA
auuucucaaacgaugucacc

SEQ ID NO: 138570 - RNA, 20 nt, Artificial Sequence
  mmSKRIPTE0009349_Cxcl17_3
  gRNA
ugaccucauagggcugagug

SEQ ID NO: 138571 - RNA, 20 nt, Artificial Sequence
  mmSKRIPTE0009350_Cxcl17_4
  gRNA
gcucuaugguacuccagaag

SEQ ID NO: 138572 - RNA, 20 nt, Artificial Sequence
  mmSKRIPTE0009351_Cxcl17_5
  gRNA
ugccucuuucauaaagaccg

SEQ ID NO: 138573 - RNA, 20 nt, Artificial Sequence
  mmSKRIPTE0009352_Cxcl17_6
  gRNA
ucaguuauaucgaucagaug

SEQ ID NO: 138574 - RNA, 20 nt, Artificial Sequence
  mmSKRIPTE0009353_Cxcl17_7
  gRNA
uguuuacccuacaagaaugc

SEQ ID NO: 138575 - RNA, 20 nt, Artificial Sequence
  mmSKRIPTE0009354_Cxcl17_8
  gRNA
guuagacucucucaguggaa

SEQ ID NO: 138576 - RNA, 20 nt, Artificial Sequence
  mmSKRIPTE0009355_Cxcl17_9
  gRNA
uggaggugcacggucuaugu

SEQ ID NO: 138577 - RNA, 20 nt, Artificial Sequence
  mmSKRIPTE0009356_Adora1_1
  gRNA
ccauuacaucuucuccgcug

SEQ ID NO: 138578 - RNA, 20 nt, Artificial Sequence
  mmSKRIPTE0009357_Adora1_2
  gRNA
uggaaggccgagauguacgg

SEQ ID NO: 138579 - RNA, 20 nt, Artificial Sequence
  mmSKRIPTE0009358_Adora1_3
  gRNA
gaagggucucacaugacacg

SEQ ID NO: 138580 - RNA, 20 nt, Artificial Sequence
  mmSKRIPTE0009359_Adora1_4
  gRNA
uggcuccuucagucagacag

SEQ ID NO: 138581 - RNA, 20 nt, Artificial Sequence
  mmSKRIPTE0009360_Adora1_5
  gRNA
gcaaugagugucaugacgga

SEQ ID NO: 138582 - RNA, 20 nt, Artificial Sequence
  mmSKRIPTE0009361_Adora1_6
  gRNA
ggauuguguucuuggccacg

SEQ ID NO: 138583 - RNA, 20 nt, Artificial Sequence
  mmSKRIPTE0009362_Adora1_7
  gRNA
caaccgguagggggucccaa

SEQ ID NO: 138584 - RNA, 20 nt, Artificial Sequence
  mmSKRIPTE0009363_Adora1_8
  gRNA
ccuucccguaguacuucugg

SEQ ID NO: 138585 - RNA, 20 nt, Artificial Sequence
  mmSKRIPTE0009364_Adora1_9
  gRNA
ugagcuccuugccuccgggu

SEQ ID NO: 138586 - RNA, 20 nt, Artificial Sequence
  mmSKRIPTE0009365_Cxcl16_1
  gRNA
gggcugcguucuuaaucccg

SEQ ID NO: 138587 - RNA, 20 nt, Artificial Sequence
  mmSKRIPTE0009366_Cxcl16_2
  gRNA
ucuggcacccagauaccgca

SEQ ID NO: 138588 - RNA, 20 nt, Artificial Sequence
  mmSKRIPTE0009367_Cxcl16_3
  gRNA
cagccguguauacagcccag

SEQ ID NO: 138589 - RNA, 20 nt, Artificial Sequence
  mmSKRIPTE0009368_Cxcl16_4
  gRNA
cgaccgucuggucgguaccg

SEQ ID NO: 138590 - RNA, 20 nt, Artificial Sequence
  mmSKRIPTE0009369_Cxcl16_5
  gRNA
cuaacgaagaaagugcuaug

SEQ ID NO: 138591 - RNA, 20 nt, Artificial Sequence
  mmSKRIPTE0009370_Cxcl16_6
  gRNA
gaauuggcuggaugucggcu

SEQ ID NO: 138592 - RNA, 20 nt, Artificial Sequence
  mmSKRIPTE0009371_Cxcl16_7
  gRNA
gaauccgagugagcaagcug

SEQ ID NO: 138593 - RNA, 20 nt, Artificial Sequence
  mmSKRIPTE0009372_Cxcl16_8
  gRNA
uggauccuacugagacccag

SEQ ID NO: 138594 - RNA, 20 nt, Artificial Sequence
  mmSKRIPTE0009373_Cxcl16_9
  gRNA
gacccugccagguuagucgg

SEQ ID NO: 138595 - RNA, 20 nt, Artificial Sequence
  mmSKRIPTE0009374_Ccl9_1
  gRNA
aaauccgcugggaaaccgag

SEQ ID NO: 138596 - RNA, 20 nt, Artificial Sequence
  mmSKRIPTE0009375_Ccl9_2
  gRNA
aagaccgcaugaguagugau

SEQ ID NO: 138597 - RNA, 20 nt, Artificial Sequence
  mmSKRIPTE0009376_Ccl9_3
  gRNA
ccuucuagaccccugaugag

SEQ ID NO: 138598 - RNA, 20 nt, Artificial Sequence
  mmSKRIPTE0009377_Ccl9_4
  gRNA
ggccaaccacaacagauuug

SEQ ID NO: 138599 - RNA, 20 nt, Artificial Sequence
  mmSKRIPTE0009378_Ccl9_5
  gRNA
auuaucuguaguagggugca

SEQ ID NO: 138600 - RNA, 20 nt, Artificial Sequence
  mmSKRIPTE0009379_Ccl9_6
  gRNA
gagauccucgaauagaauug

SEQ ID NO: 138601 - RNA, 20 nt, Artificial Sequence
  mmSKRIPTE0009380_Ccl9_7
  gRNA
aaauuguaccaugggccggg

SEQ ID NO: 138602 - RNA, 20 nt, Artificial Sequence
  mmSKRIPTE0009381_Ccl9_8
  gRNA
uuuaagcaaaagucccgagu

SEQ ID NO: 138603 - RNA, 20 nt, Artificial Sequence
  mmSKRIPTE0009382_Ccl9_9
  gRNA
gcagugucucuauuguucag

SEQ ID NO: 138604 - RNA, 20 nt, Artificial Sequence
  mmSKRIPTE0009383_Ccl4_1
  gRNA
aaauguuaucuaacugacgg

SEQ ID NO: 138605 - RNA, 20 nt, Artificial Sequence
  mmSKRIPTE0009384_Ccl4_2
  gRNA
uauaggacgcgugucuccca

SEQ ID NO: 138606 - RNA, 20 nt, Artificial Sequence
  mmSKRIPTE0009385_Ccl4_3
  gRNA
cccagagucccuauaaagag

SEQ ID NO: 138607 - RNA, 20 nt, Artificial Sequence
  mmSKRIPTE0009386_Ccl4_4
  gRNA
cuaguccagucuuccaacug

SEQ ID NO: 138608 - RNA, 20 nt, Artificial Sequence
  mmSKRIPTE0009387_Ccl4_5
  gRNA
gagcuucaugguguugcucg

SEQ ID NO: 138609 - RNA, 20 nt, Artificial Sequence
  mmSKRIPTE0009388_Ccl4_6
  gRNA
augagggcaagauucgaaaa

SEQ ID NO: 138610 - RNA, 20 nt, Artificial Sequence
  mmSKRIPTE0009389_Ccl4_7
  gRNA
aaaucugaacgugaggagca

SEQ ID NO: 138611 - RNA, 20 nt, Artificial Sequence
  mmSKRIPTE0009390_Ccl4_8
  gRNA
gcuggaugggcaguaaagug

SEQ ID NO: 138612 - RNA, 20 nt, Artificial Sequence
  mmSKRIPTE0009391_Ccl4_9
  gRNA
agcacagaugagaaccccau

SEQ ID NO: 138613 - RNA, 20 nt, Artificial Sequence
  mmSKRIPTE0009392_Gli3_1
  gRNA
cugaacugaacauccaugcg

SEQ ID NO: 138614 - RNA, 20 nt, Artificial Sequence
  mmSKRIPTE0009393_Gli3_2
  gRNA
guucugauuugguucaaccg

SEQ ID NO: 138615 - RNA, 20 nt, Artificial Sequence
  mmSKRIPTE0009394_Gli3_3
  gRNA
cucucaucacuagacgucga

SEQ ID NO: 138616 - RNA, 20 nt, Artificial Sequence
  mmSKRIPTE0009395_Gli3_4
  gRNA
gaucucuuucuugaucagcg

SEQ ID NO: 138617 - RNA, 20 nt, Artificial Sequence
  mmSKRIPTE0009396_Gli3_5
  gRNA
gcugcagugggauuacggug

SEQ ID NO: 138618 - RNA, 20 nt, Artificial Sequence
  mmSKRIPTE0009397_Gli3_6
  gRNA
cuucaggcgggacguaccug

SEQ ID NO: 138619 - RNA, 20 nt, Artificial Sequence
  mmSKRIPTE0009398_Gli3_7
  gRNA
uucccacaugacagacaccg

SEQ ID NO: 138620 - RNA, 20 nt, Artificial Sequence
  mmSKRIPTE0009399_Gli3_8
  gRNA
gccugacugaucccagcgug

SEQ ID NO: 138621 - RNA, 20 nt, Artificial Sequence
  mmSKRIPTE0009400_Gli3_9
  gRNA
agggcaagucuggauacguc

SEQ ID NO: 138622 - RNA, 20 nt, Artificial Sequence
  mmSKRIPTE0009401_Trdv4_1
  gRNA
gaagcggaacuguagcaccg

SEQ ID NO: 138623 - RNA, 20 nt, Artificial Sequence
  mmSKRIPTE0009402_Trdv4_2
  gRNA
cuacugcacuguaacaggag

SEQ ID NO: 138624 - RNA, 20 nt, Artificial Sequence
  mmSKRIPTE0009403_Trdv4_3
  gRNA
gaaaggcuagggucagacga

SEQ ID NO: 138625 - RNA, 20 nt, Artificial Sequence
  mmSKRIPTE0009404_Trdv4_4
  gRNA
aggaugaguuuguaaucggc

SEQ ID NO: 138626 - RNA, 20 nt, Artificial Sequence
  mmSKRIPTE0009405_Trdv4_5
  gRNA
ugacuguuaauguaaucagg

SEQ ID NO: 138627 - RNA, 20 nt, Artificial Sequence
  mmSKRIPTE0009406_Trdv4_6
  gRNA
cuaucuggccugcaaucggg

SEQ ID NO: 138628 - RNA, 20 nt, Artificial Sequence
  mmSKRIPTE0009407_Trdv4_7
  gRNA
gacgcugguacguacuacug

SEQ ID NO: 138629 - RNA, 20 nt, Artificial Sequence
  mmSKRIPTE0009408_Trdv4_8
  gRNA
aagcuagugaggucauggac

SEQ ID NO: 138630 - RNA, 20 nt, Artificial Sequence
  mmSKRIPTE0009409_Trdv4_9
  gRNA
caaaccccauccccuugggg

SEQ ID NO: 138631 - RNA, 20 nt, Artificial Sequence
  mmSKRIPTE0009410_Mir155_1
  gRNA
acaucuacguucauccagca

SEQ ID NO: 138632 - RNA, 20 nt, Artificial Sequence
  mmSKRIPTE0009411_Mir155_2
  gRNA
gacuugucauccucccacgg

SEQ ID NO: 138633 - RNA, 20 nt, Artificial Sequence
  mmSKRIPTE0009412_Mir155_3
  gRNA
uccuguuaaugcuaacaggu

SEQ ID NO: 138634 - RNA, 20 nt, Artificial Sequence
  mmSKRIPTE0009413_Mir155_4
  gRNA
auuuaucguaacacuuacag

SEQ ID NO: 138635 - RNA, 20 nt, Artificial Sequence
  mmSKRIPTE0009414_Mir155_5
  gRNA
gugaacgauuaugaaucuga

SEQ ID NO: 138636 - RNA, 20 nt, Artificial Sequence
  mmSKRIPTE0009415_Mir155_6
  gRNA
aguggacuauccuaguaacc

SEQ ID NO: 138637 - RNA, 20 nt, Artificial Sequence
  mmSKRIPTE0009416_Mir155_7
  gRNA
gcaggugcugcaaaccagga

SEQ ID NO: 138638 - RNA, 20 nt, Artificial Sequence
  mmSKRIPTE0009417_Mir155_8
  gRNA
guuaaugcuaauugugauag

SEQ ID NO: 138639 - RNA, 20 nt, Artificial Sequence
  mmSKRIPTE0009418_Mir155_9
  gRNA
cuccagcagccagaggauaa

SEQ ID NO: 138640 - RNA, 20 nt, Artificial Sequence
  mmSKRIPTE0009419_Cd226_1
  gRNA
gcuuugcuaucguacaggga

SEQ ID NO: 138641 - RNA, 20 nt, Artificial Sequence
  mmSKRIPTE0009420_Cd226_2
  gRNA
guuuacgacauuauucguug

SEQ ID NO: 138642 - RNA, 20 nt, Artificial Sequence
  mmSKRIPTE0009421_Cd226_3
  gRNA
acuuuacagaugucgcucag

SEQ ID NO: 138643 - RNA, 20 nt, Artificial Sequence
  mmSKRIPTE0009422_Cd226_4
  gRNA
auugacgcauaacuuaaccc

SEQ ID NO: 138644 - RNA, 20 nt, Artificial Sequence
  mmSKRIPTE0009423_Cd226_5
  gRNA
uuggcagucaaacaucacug

SEQ ID NO: 138645 - RNA, 20 nt, Artificial Sequence
  mmSKRIPTE0009424_Cd226_6
  gRNA
gcagacagguagcuauccga

SEQ ID NO: 138646 - RNA, 20 nt, Artificial Sequence
  mmSKRIPTE0009425_Cd226_7
  gRNA
acuuccuaaacucaacagug

SEQ ID NO: 138647 - RNA, 20 nt, Artificial Sequence
  mmSKRIPTE0009426_Cd226_8
  gRNA
aagcaacccacuuaucugca

SEQ ID NO: 138648 - RNA, 20 nt, Artificial Sequence
  mmSKRIPTE0009427_Cd226_9
  gRNA
ucgaguaugaaaagugcaug

SEQ ID NO: 138649 - RNA, 20 nt, Artificial Sequence
  mmSKRIPTE0009428_Pilrb1_1
  gRNA
uggagcacacaagcgaccag

SEQ ID NO: 138650 - RNA, 20 nt, Artificial Sequence
  mmSKRIPTE0009429_Pilrb1_2
  gRNA
acccaacucaacgugaccca

SEQ ID NO: 138651 - RNA, 20 nt, Artificial Sequence
  mmSKRIPTE0009430_Pilrb1_3
  gRNA
auuaacucgacuaaaguacu

SEQ ID NO: 138652 - RNA, 20 nt, Artificial Sequence
  mmSKRIPTE0009431_Pilrb1_4
  gRNA
agucagaaaagcauuucgcg

SEQ ID NO: 138653 - RNA, 20 nt, Artificial Sequence
  mmSKRIPTE0009432_Pilrb1_5
  gRNA
cuguguccggacaacgugag

SEQ ID NO: 138654 - RNA, 20 nt, Artificial Sequence
  mmSKRIPTE0009433_Pilrb1_6
  gRNA
gauccccaggcauucacaug

SEQ ID NO: 138655 - RNA, 20 nt, Artificial Sequence
  mmSKRIPTE0009434_Pilrb1_7
  gRNA
cugaggcugaauaugcaggg

SEQ ID NO: 138656 - RNA, 20 nt, Artificial Sequence
  mmSKRIPTE0009435_Pilrb1_8
  gRNA
uuucucucugaccugcaucg

SEQ ID NO: 138657 - RNA, 20 nt, Artificial Sequence
  mmSKRIPTE0009436_Pilrb1_9
  gRNA
gaaccacagcccaagaauag

SEQ ID NO: 138658 - RNA, 20 nt, Artificial Sequence
  mmSKRIPTE0009437_Ccl17_1
  gRNA
gcgugggauaaccuccagag

SEQ ID NO: 138659 - RNA, 20 nt, Artificial Sequence
  mmSKRIPTE0009438_Ccl17_2
  gRNA
acagagggauacucacacga

SEQ ID NO: 138660 - RNA, 20 nt, Artificial Sequence
  mmSKRIPTE0009439_Ccl17_3
  gRNA
agagaauggucacucgacuc

SEQ ID NO: 138661 - RNA, 20 nt, Artificial Sequence
  mmSKRIPTE0009440_Ccl17_4
  gRNA
auggaaggcguucugcacug

SEQ ID NO: 138662 - RNA, 20 nt, Artificial Sequence
  mmSKRIPTE0009441_Ccl17_5
  gRNA
aacguacugacccagucuga

SEQ ID NO: 138663 - RNA, 20 nt, Artificial Sequence
  mmSKRIPTE0009442_Ccl17_6
  gRNA
cauacaucggaacauuccau

SEQ ID NO: 138664 - RNA, 20 nt, Artificial Sequence
  mmSKRIPTE0009443_Ccl17_7
  gRNA
cauggccccauacaaaugag

SEQ ID NO: 138665 - RNA, 20 nt, Artificial Sequence
  mmSKRIPTE0009444_Ccl17_8
  gRNA
cugccuggauuacuucaaag

SEQ ID NO: 138666 - RNA, 20 nt, Artificial Sequence
  mmSKRIPTE0009445_Ccl17_9
  gRNA
ucagauuggugaaaaaccca

SEQ ID NO: 138667 - RNA, 20 nt, Artificial Sequence
  mmSKRIPTE0009446_Nradd_1
  gRNA
gacaggaaugauguugcucg

SEQ ID NO: 138668 - RNA, 20 nt, Artificial Sequence
  mmSKRIPTE0009447_Nradd_2
  gRNA
ccacucagcuaggaagacga

SEQ ID NO: 138669 - RNA, 20 nt, Artificial Sequence
  mmSKRIPTE0009448_Nradd_3
  gRNA
agccgaccaaucuugugcug

SEQ ID NO: 138670 - RNA, 20 nt, Artificial Sequence
  mmSKRIPTE0009449_Nradd_4
  gRNA
cuucugcgugcuccggcgug

SEQ ID NO: 138671 - RNA, 20 nt, Artificial Sequence
  mmSKRIPTE0009450_Nradd_5
  gRNA
aggcggcacucacaccaccg

SEQ ID NO: 138672 - RNA, 20 nt, Artificial Sequence
  mmSKRIPTE0009451_Nradd_6
  gRNA
aagguguggucuauucaggu

SEQ ID NO: 138673 - RNA, 20 nt, Artificial Sequence
  mmSKRIPTE0009452_Nradd_7
  gRNA
caggaucagagcacuaaagg

SEQ ID NO: 138674 - RNA, 20 nt, Artificial Sequence
  mmSKRIPTE0009453_Nradd_8
  gRNA
cuagccgggcucuugcuagg

SEQ ID NO: 138675 - RNA, 20 nt, Artificial Sequence
  mmSKRIPTE0009454_Nradd_9
  gRNA
ggguaccagcgucuguguug

SEQ ID NO: 138676 - RNA, 20 nt, Artificial Sequence
  mmSKRIPTE0009455_Csf2_1
  gRNA
auauucgagcagggucuacg

SEQ ID NO: 138677 - RNA, 20 nt, Artificial Sequence
  mmSKRIPTE0009456_Csf2_2
  gRNA
ucaaugcugucauggccaaa

SEQ ID NO: 138678 - RNA, 20 nt, Artificial Sequence
  mmSKRIPTE0009457_Csf2_3
  gRNA
aauacagaaaccacuuacug

SEQ ID NO: 138679 - RNA, 20 nt, Artificial Sequence
  mmSKRIPTE0009458_Csf2_4
  gRNA
cccucccagacuaagaccug

SEQ ID NO: 138680 - RNA, 20 nt, Artificial Sequence
  mmSKRIPTE0009459_Csf2_5
  gRNA
ggaugacaugccugucacgu

SEQ ID NO: 138681 - RNA, 20 nt, Artificial Sequence
  mmSKRIPTE0009460_Csf2_6
  gRNA
acgugacugcuacagaggaa

SEQ ID NO: 138682 - RNA, 20 nt, Artificial Sequence
  mmSKRIPTE0009461_Csf2_7
  gRNA
ccggccuuggaagcauguag

SEQ ID NO: 138683 - RNA, 20 nt, Artificial Sequence
  mmSKRIPTE0009462_Csf2_8
  gRNA
guggcacagccacaguugga

SEQ ID NO: 138684 - RNA, 20 nt, Artificial Sequence
  mmSKRIPTE0009463_Csf2_9
  gRNA
guccagguaagugggccacg

SEQ ID NO: 138685 - RNA, 20 nt, Artificial Sequence
  mmSKRIPTE0009464_Ighv7-4_1
  gRNA
guaaaagcuguacacagcga

SEQ ID NO: 138686 - RNA, 20 nt, Artificial Sequence
  mmSKRIPTE0009465_Ighv7-4_2
  gRNA
auacugcaucuguuaagggu

SEQ ID NO: 138687 - RNA, 20 nt, Artificial Sequence
  mmSKRIPTE0009466_Ighv7-4_3
  gRNA
auguuaaguaguaaaaggag

SEQ ID NO: 138688 - RNA, 20 nt, Artificial Sequence
  mmSKRIPTE0009467_Ighv7-4_4
  gRNA
aggcuggggaaaucaagacu

SEQ ID NO: 138689 - RNA, 20 nt, Artificial Sequence
  mmSKRIPTE0009468_Ighv7-4_5
  gRNA
ucuucaaaugaacacccuga

SEQ ID NO: 138690 - RNA, 20 nt, Artificial Sequence
  mmSKRIPTE0009469_Ighv7-4_6
  gRNA
gcuacagcgagagucuucac

SEQ ID NO: 138691 - RNA, 20 nt, Artificial Sequence
  mmSKRIPTE0009470_Ighv7-4_7
  gRNA
accugucaccaugaaguugu

SEQ ID NO: 138692 - RNA, 20 nt, Artificial Sequence
  mmSKRIPTE0009471_Ighv7-4_8
  gRNA
ugguaauuuauggggaacaa

SEQ ID NO: 138693 - RNA, 20 nt, Artificial Sequence
  mmSKRIPTE0009472_Ighv7-4_9
  gRNA
cuaaucaaagccaaccacuc

SEQ ID NO: 138694 - RNA, 20 nt, Artificial Sequence
  mmSKRIPTE0009473_Ighv3-6_1
  gRNA
cuaaguuaaauccccucuug

SEQ ID NO: 138695 - RNA, 20 nt, Artificial Sequence
  mmSKRIPTE0009474_Ighv3-6_2
  gRNA
gaaaacaggguguugccuaa

SEQ ID NO: 138696 - RNA, 20 nt, Artificial Sequence
  mmSKRIPTE0009475_Ighv3-6_3
  gRNA
augggcuacauaagcuacga

SEQ ID NO: 138697 - RNA, 20 nt, Artificial Sequence
  mmSKRIPTE0009476_Ighv3-6_4
  gRNA
guaugugacaagcccccugu

SEQ ID NO: 138698 - RNA, 20 nt, Artificial Sequence
  mmSKRIPTE0009477_Ighv3-6_5
  gRNA
gagacugagaagguuucacg

SEQ ID NO: 138699 - RNA, 20 nt, Artificial Sequence
  mmSKRIPTE0009478_Ighv3-6_6
  gRNA
cagcccagccuucauaauug

SEQ ID NO: 138700 - RNA, 20 nt, Artificial Sequence
  mmSKRIPTE0009479_Ighv3-6_7
  gRNA
uauuucauacauguaccaug

SEQ ID NO: 138701 - RNA, 20 nt, Artificial Sequence
  mmSKRIPTE0009480_Ighv3-6_8
  gRNA
cuuagaugugucacgaguga

SEQ ID NO: 138702 - RNA, 20 nt, Artificial Sequence
  mmSKRIPTE0009481_Ighv3-6_9
  gRNA
uucuugcccaaaacucuggc

SEQ ID NO: 138703 - RNA, 20 nt, Artificial Sequence
  mmSKRIPTE0009482_Myc_1
  gRNA
auugaauuaaugccaaugag

SEQ ID NO: 138704 - RNA, 20 nt, Artificial Sequence
  mmSKRIPTE0009483_Myc_2
  gRNA
cguccgggauucaggaggcg

SEQ ID NO: 138705 - RNA, 20 nt, Artificial Sequence
  mmSKRIPTE0009484_Myc_3
  gRNA
guagcgaccgcaacauagga

SEQ ID NO: 138706 - RNA, 20 nt, Artificial Sequence
  mmSKRIPTE0009485_Myc_4
  gRNA
cgagugcauugaccccucag

SEQ ID NO: 138707 - RNA, 20 nt, Artificial Sequence
  mmSKRIPTE0009486_Myc_5
  gRNA
ggucaucaucuccagcugau

SEQ ID NO: 138708 - RNA, 20 nt, Artificial Sequence
  mmSKRIPTE0009487_Myc_6
  gRNA
ucgggcucaucuccaucccg

SEQ ID NO: 138709 - RNA, 20 nt, Artificial Sequence
  mmSKRIPTE0009488_Myc_7
  gRNA
aagccccagccaagguugug

SEQ ID NO: 138710 - RNA, 20 nt, Artificial Sequence
  mmSKRIPTE0009489_Myc_8
  gRNA
gacgagcgucacugauagua

SEQ ID NO: 138711 - RNA, 20 nt, Artificial Sequence
  mmSKRIPTE0009490_Myc_9
  gRNA
agggcuaagucccugcucga

SEQ ID NO: 138712 - RNA, 20 nt, Artificial Sequence
  mmSKRIPTE0009491_Fshb_1
  gRNA
aaugaaggaauaaacgacga

SEQ ID NO: 138713 - RNA, 20 nt, Artificial Sequence
  mmSKRIPTE0009492_Fshb_2
  gRNA
ugcgggcuacugcuacacua

SEQ ID NO: 138714 - RNA, 20 nt, Artificial Sequence
  mmSKRIPTE0009493_Fshb_3
  gRNA
gcauuuagacugcuuuggcg

SEQ ID NO: 138715 - RNA, 20 nt, Artificial Sequence
  mmSKRIPTE0009494_Fshb_4
  gRNA
uacgagaccguaagauugcc

SEQ ID NO: 138716 - RNA, 20 nt, Artificial Sequence
  mmSKRIPTE0009495_Fshb_5
  gRNA
ugagcagccuaaccuugugg

SEQ ID NO: 138717 - RNA, 20 nt, Artificial Sequence
  mmSKRIPTE0009496_Fshb_6
  gRNA
ugguguauaaggacccagcu

SEQ ID NO: 138718 - RNA, 20 nt, Artificial Sequence
  mmSKRIPTE0009497_Fshb_7
  gRNA
uaacacccaguaaauccaca

SEQ ID NO: 138719 - RNA, 20 nt, Artificial Sequence
  mmSKRIPTE0009498_Fshb_8
  gRNA
ugguccuucaggacaagggu

SEQ ID NO: 138720 - RNA, 20 nt, Artificial Sequence
  mmSKRIPTE0009499_Fshb_9
  gRNA
gcucaagccgaagacuugag

SEQ ID NO: 138721 - RNA, 20 nt, Artificial Sequence
  mmSKRIPTE0009500_Tlr4_1
  gRNA
auucucccaagaucaaccga

SEQ ID NO: 138722 - RNA, 20 nt, Artificial Sequence
  mmSKRIPTE0009501_Tlr4_2
  gRNA
aggcuuccacaagagccgga

SEQ ID NO: 138723 - RNA, 20 nt, Artificial Sequence
  mmSKRIPTE0009502_Tlr4_3
  gRNA
cuaacuucccuccugcgacg

SEQ ID NO: 138724 - RNA, 20 nt, Artificial Sequence
  mmSKRIPTE0009503_Tlr4_4
  gRNA
uaaaugcuacagcucaccug

SEQ ID NO: 138725 - RNA, 20 nt, Artificial Sequence
  mmSKRIPTE0009504_Tlr4_5
  gRNA
ugaaggcagaggugaaagcg

SEQ ID NO: 138726 - RNA, 20 nt, Artificial Sequence
  mmSKRIPTE0009505_Tlr4_6
  gRNA
aaugggaggacaauccucug

SEQ ID NO: 138727 - RNA, 20 nt, Artificial Sequence
  mmSKRIPTE0009506_Tlr4_7
  gRNA
auggcugcuaagcuauagca

SEQ ID NO: 138728 - RNA, 20 nt, Artificial Sequence
  mmSKRIPTE0009507_Tlr4_8
  gRNA
uagauagcugagacuuggua

SEQ ID NO: 138729 - RNA, 20 nt, Artificial Sequence
  mmSKRIPTE0009508_Tlr4_9
  gRNA
ucucugaggccaguauucac

SEQ ID NO: 138730 - RNA, 20 nt, Artificial Sequence
  mmSKRIPTE0009509_Cxcl13_1
  gRNA
uaaacuauccuagauugucg

SEQ ID NO: 138731 - RNA, 20 nt, Artificial Sequence
  mmSKRIPTE0009510_Cxcl13_2
  gRNA
auaagugaaaguucucaccg

SEQ ID NO: 138732 - RNA, 20 nt, Artificial Sequence
  mmSKRIPTE0009511_Cxcl13_3
  gRNA
guucugcuauugucacacau

SEQ ID NO: 138733 - RNA, 20 nt, Artificial Sequence
  mmSKRIPTE0009512_Cxcl13_4
  gRNA
gauuuguggugugaggccug

SEQ ID NO: 138734 - RNA, 20 nt, Artificial Sequence
  mmSKRIPTE0009513_Cxcl13_5
  gRNA
gugugaauccucgugccaaa

SEQ ID NO: 138735 - RNA, 20 nt, Artificial Sequence
  mmSKRIPTE0009514_Cxcl13_6
  gRNA
gcagcugaccuaagaaagag

SEQ ID NO: 138736 - RNA, 20 nt, Artificial Sequence
  mmSKRIPTE0009515_Cxcl13_7
  gRNA
uuugcacccuuguaaaacgc

SEQ ID NO: 138737 - RNA, 20 nt, Artificial Sequence
  mmSKRIPTE0009516_Cxcl13_8
  gRNA
uuaccacaugcaucugaagu

SEQ ID NO: 138738 - RNA, 20 nt, Artificial Sequence
  mmSKRIPTE0009517_Cxcl13_9
  gRNA
gauguggguuggguaugcaa

SEQ ID NO: 138739 - RNA, 20 nt, Artificial Sequence
  mmSKRIPTE0009518_Ins2_1
  gRNA
gucccaaguuacuaccacca

SEQ ID NO: 138740 - RNA, 20 nt, Artificial Sequence
  mmSKRIPTE0009519_Ins2_2
  gRNA
ggagggucucgggauaacca

SEQ ID NO: 138741 - RNA, 20 nt, Artificial Sequence
  mmSKRIPTE0009520_Ins2_3
  gRNA
gcaaaaguuucacguaagag

SEQ ID NO: 138742 - RNA, 20 nt, Artificial Sequence
  mmSKRIPTE0009521_Ins2_4
  gRNA
uguagcggaucacuuagggc

SEQ ID NO: 138743 - RNA, 20 nt, Artificial Sequence
  mmSKRIPTE0009522_Ins2_5
  gRNA
aaccaggguaguuagcacug

SEQ ID NO: 138744 - RNA, 20 nt, Artificial Sequence
  mmSKRIPTE0009523_Ins2_6
  gRNA
uuuggucuauaaagguagug

SEQ ID NO: 138745 - RNA, 20 nt, Artificial Sequence
  mmSKRIPTE0009524_Ins2_7
  gRNA
uccagguuauuguuucaaca

SEQ ID NO: 138746 - RNA, 20 nt, Artificial Sequence
  mmSKRIPTE0009525_Ins2_8
  gRNA
gagcaaccuccuacuacccc

SEQ ID NO: 138747 - RNA, 20 nt, Artificial Sequence
  mmSKRIPTE0009526_Ins2_9
  gRNA
gagguggcccagcagaagcg

SEQ ID NO: 138748 - RNA, 20 nt, Artificial Sequence
  mmSKRIPTE0009527_Lax1_1
  gRNA
gggaaugccacggaccacga

SEQ ID NO: 138749 - RNA, 20 nt, Artificial Sequence
  mmSKRIPTE0009528_Lax1_2
  gRNA
cccuggccuuauuagcacac

SEQ ID NO: 138750 - RNA, 20 nt, Artificial Sequence
  mmSKRIPTE0009529_Lax1_3
  gRNA
uugauccugagaauccccca

SEQ ID NO: 138751 - RNA, 20 nt, Artificial Sequence
  mmSKRIPTE0009530_Lax1_4
  gRNA
uagaguguccguucauacug

SEQ ID NO: 138752 - RNA, 20 nt, Artificial Sequence
  mmSKRIPTE0009531_Lax1_5
  gRNA
ugcaugcagaggguaaacuu

SEQ ID NO: 138753 - RNA, 20 nt, Artificial Sequence
  mmSKRIPTE0009532_Lax1_6
  gRNA
aauuucaggugaagguaggg

SEQ ID NO: 138754 - RNA, 20 nt, Artificial Sequence
  mmSKRIPTE0009533_Lax1_7
  gRNA
aaaugccacuuauaggcugu

SEQ ID NO: 138755 - RNA, 20 nt, Artificial Sequence
  mmSKRIPTE0009534_Lax1_8
  gRNA
cuggacaacucugaacagag

SEQ ID NO: 138756 - RNA, 20 nt, Artificial Sequence
  mmSKRIPTE0009535_Lax1_9
  gRNA
gguggaggcagagucaacga

SEQ ID NO: 138757 - RNA, 20 nt, Artificial Sequence
  mmSKRIPTE0009536_Klrd1_1
  gRNA
gugacuaggucauucacucg

SEQ ID NO: 138758 - RNA, 20 nt, Artificial Sequence
  mmSKRIPTE0009537_Klrd1_2
  gRNA
aaacgcuuugccucguggag

SEQ ID NO: 138759 - RNA, 20 nt, Artificial Sequence
  mmSKRIPTE0009538_Klrd1_3
  gRNA
uaaccucuccaaccugagca

SEQ ID NO: 138760 - RNA, 20 nt, Artificial Sequence
  mmSKRIPTE0009539_Klrd1_4
  gRNA
uaaaucuucaugacucagag

SEQ ID NO: 138761 - RNA, 20 nt, Artificial Sequence
  mmSKRIPTE0009540_Klrd1_5
  gRNA
gcaagcuuugaacaagaccc

SEQ ID NO: 138762 - RNA, 20 nt, Artificial Sequence
  mmSKRIPTE0009541_Klrd1_6
  gRNA
uaguuucuaggaucacucgg

SEQ ID NO: 138763 - RNA, 20 nt, Artificial Sequence
  mmSKRIPTE0009542_Klrd1_7
  gRNA
acuauuacaucugcugacag

SEQ ID NO: 138764 - RNA, 20 nt, Artificial Sequence
  mmSKRIPTE0009543_Klrd1_8
  gRNA
guauagacaaggaaggucca

SEQ ID NO: 138765 - RNA, 20 nt, Artificial Sequence
  mmSKRIPTE0009544_Klrd1_9
  gRNA
aagaaaugccuggcuauggg

SEQ ID NO: 138766 - RNA, 20 nt, Artificial Sequence
  mmSKRIPTE0009545_Ighv6-6_1
  gRNA
gauacugcaugugauuagag

SEQ ID NO: 138767 - RNA, 20 nt, Artificial Sequence
  mmSKRIPTE0009546_Ighv6-6_2
  gRNA
uaccauucuacuaucaagug

SEQ ID NO: 138768 - RNA, 20 nt, Artificial Sequence
  mmSKRIPTE0009547_Ighv6-6_3
  gRNA
ucuuuauagagcucuuaggg

SEQ ID NO: 138769 - RNA, 20 nt, Artificial Sequence
  mmSKRIPTE0009548_Ighv6-6_4
  gRNA
gugcuauaucaugaguucag

SEQ ID NO: 138770 - RNA, 20 nt, Artificial Sequence
  mmSKRIPTE0009549_Ighv6-6_5
  gRNA
accucagaaaaccugcagca

SEQ ID NO: 138771 - RNA, 20 nt, Artificial Sequence
  mmSKRIPTE0009550_Ighv6-6_6
  gRNA
cuggcggacccaguccaucc

SEQ ID NO: 138772 - RNA, 20 nt, Artificial Sequence
  mmSKRIPTE0009551_Ighv6-6_7
  gRNA
gcacaguggccauguaaacc

SEQ ID NO: 138773 - RNA, 20 nt, Artificial Sequence
  mmSKRIPTE0009552_Ighv6-6_8
  gRNA
agaacauucacgauguacuu

SEQ ID NO: 138774 - RNA, 20 nt, Artificial Sequence
  mmSKRIPTE0009553_Ighv6-6_9
  gRNA
acuaugcugagucugugaaa

SEQ ID NO: 138775 - RNA, 20 nt, Artificial Sequence
  mmSKRIPTE0009554_Tff2_1
  gRNA
ugauaacugucccuuacucg

SEQ ID NO: 138776 - RNA, 20 nt, Artificial Sequence
  mmSKRIPTE0009555_Tff2_2
  gRNA
aggagggcacuaauguuggg

SEQ ID NO: 138777 - RNA, 20 nt, Artificial Sequence
  mmSKRIPTE0009556_Tff2_3
  gRNA
accaucuugacccuuagcag

SEQ ID NO: 138778 - RNA, 20 nt, Artificial Sequence
  mmSKRIPTE0009557_Tff2_4
  gRNA
aaccguuagagauuccccaa

SEQ ID NO: 138779 - RNA, 20 nt, Artificial Sequence
  mmSKRIPTE0009558_Tff2_5
  gRNA
cuuugacucuagcgucgcug

SEQ ID NO: 138780 - RNA, 20 nt, Artificial Sequence
  mmSKRIPTE0009559_Tff2_6
  gRNA
uucagaaccugucuaugaug

SEQ ID NO: 138781 - RNA, 20 nt, Artificial Sequence
  mmSKRIPTE0009560_Tff2_7
  gRNA
ggagcagacaugcgaccucg

SEQ ID NO: 138782 - RNA, 20 nt, Artificial Sequence
  mmSKRIPTE0009561_Tff2_8
  gRNA
cgcacacauucgcguacgau

SEQ ID NO: 138783 - RNA, 20 nt, Artificial Sequence
  mmSKRIPTE0009562_Tff2_9
  gRNA
gcuagcccagguuaacacga

SEQ ID NO: 138784 - RNA, 20 nt, Artificial Sequence
  mmSKRIPTE0009563_Ighv3-5_1
  gRNA
auaggguacauauacuacag

SEQ ID NO: 138785 - RNA, 20 nt, Artificial Sequence
  mmSKRIPTE0009564_Ighv3-5_2
  gRNA
augaaauggcaacucucacc

SEQ ID NO: 138786 - RNA, 20 nt, Artificial Sequence
  mmSKRIPTE0009565_Ighv3-5_3
  gRNA
gucucgugcacaguaguaug

SEQ ID NO: 138787 - RNA, 20 nt, Artificial Sequence
  mmSKRIPTE0009566_Ighv3-5_4
  gRNA
gaaaaggggguauagccuaa

SEQ ID NO: 138788 - RNA, 20 nt, Artificial Sequence
  mmSKRIPTE0009567_Ighv3-5_5
  gRNA
ucaccacuggaaauuacagg

SEQ ID NO: 138789 - RNA, 20 nt, Artificial Sequence
  mmSKRIPTE0009568_Ighv3-5_6
  gRNA
cuacaaggagguuuacaucu

SEQ ID NO: 138790 - RNA, 20 nt, Artificial Sequence
  mmSKRIPTE0009569_Ighv3-5_7
  gRNA
aaugaacucuuugacugcug

SEQ ID NO: 138791 - RNA, 20 nt, Artificial Sequence
  mmSKRIPTE0009570_Ighv3-5_8
  gRNA
gcucauaucugucuuacagg

SEQ ID NO: 138792 - RNA, 20 nt, Artificial Sequence
  mmSKRIPTE0009571_Ighv3-5_9
  gRNA
uugccccauacacuuagcac

SEQ ID NO: 138793 - RNA, 20 nt, Artificial Sequence
  mmSKRIPTE0009572_Id2_1
  gRNA
ugaugcaggcugacgauagu

SEQ ID NO: 138794 - RNA, 20 nt, Artificial Sequence
  mmSKRIPTE0009573_Id2_2
  gRNA
ugccgcuugacuuaccacau

SEQ ID NO: 138795 - RNA, 20 nt, Artificial Sequence
  mmSKRIPTE0009574_Id2_3
  gRNA
aaggcuuucaugcugcucgu

SEQ ID NO: 138796 - RNA, 20 nt, Artificial Sequence
  mmSKRIPTE0009575_Id2_4
  gRNA
cucccggagcaaaaccccgg

SEQ ID NO: 138797 - RNA, 20 nt, Artificial Sequence
  mmSKRIPTE0009576_Id2_5
  gRNA
uaccgaaacgcgcacacagg

SEQ ID NO: 138798 - RNA, 20 nt, Artificial Sequence
  mmSKRIPTE0009577_Id2_6
  gRNA
agaaugaagcgcgagccggg

SEQ ID NO: 138799 - RNA, 20 nt, Artificial Sequence
  mmSKRIPTE0009578_Id2_7
  gRNA
agggggcugagcugacugcg

SEQ ID NO: 138800 - RNA, 20 nt, Artificial Sequence
  mmSKRIPTE0009579_Id2_8
  gRNA
uucagggaugcccgauugag

SEQ ID NO: 138801 - RNA, 20 nt, Artificial Sequence
  mmSKRIPTE0009580_Id2_9
  gRNA
uaaugaaccugucucuacga

SEQ ID NO: 138802 - RNA, 20 nt, Artificial Sequence
  mmSKRIPTE0009581_P2rx7_1
  gRNA
acccacucugauaggacgca

SEQ ID NO: 138803 - RNA, 20 nt, Artificial Sequence
  mmSKRIPTE0009582_P2rx7_2
  gRNA
uuuccuacauuagguaagcg

SEQ ID NO: 138804 - RNA, 20 nt, Artificial Sequence
  mmSKRIPTE0009583_P2rx7_3
  gRNA
ggguuguugucgcaguucug

SEQ ID NO: 138805 - RNA, 20 nt, Artificial Sequence
  mmSKRIPTE0009584_P2rx7_4
  gRNA
ugagcgauaagcuguaccag

SEQ ID NO: 138806 - RNA, 20 nt, Artificial Sequence
  mmSKRIPTE0009585_P2rx7_5
  gRNA
aaugagacccuagaccccua

SEQ ID NO: 138807 - RNA, 20 nt, Artificial Sequence
  mmSKRIPTE0009586_P2rx7_6
  gRNA
ucaccagauauagacgcaga

SEQ ID NO: 138808 - RNA, 20 nt, Artificial Sequence
  mmSKRIPTE0009587_P2rx7_7
  gRNA
auauagcaccaagcaugacg

SEQ ID NO: 138809 - RNA, 20 nt, Artificial Sequence
  mmSKRIPTE0009588_P2rx7_8
  gRNA
acucucccugcuacaaacug

SEQ ID NO: 138810 - RNA, 20 nt, Artificial Sequence
  mmSKRIPTE0009589_P2rx7_9
  gRNA
uagacugcugcauacccaca

SEQ ID NO: 138811 - RNA, 20 nt, Artificial Sequence
  mmSKRIPTE0009590_Il1f8_1
  gRNA
uagcagcgggugaacaacug

SEQ ID NO: 138812 - RNA, 20 nt, Artificial Sequence
  mmSKRIPTE0009591_Il1f8_2
  gRNA
aucuccuucuaaucucaccg

SEQ ID NO: 138813 - RNA, 20 nt, Artificial Sequence
  mmSKRIPTE0009592_Il1f8_3
  gRNA
cacaguuacauggcuaacgu

SEQ ID NO: 138814 - RNA, 20 nt, Artificial Sequence
  mmSKRIPTE0009593_Il1f8_4
  gRNA
gggagccacacauauaggug

SEQ ID NO: 138815 - RNA, 20 nt, Artificial Sequence
  mmSKRIPTE0009594_Il1f8_5
  gRNA
aguuaugacagcaggcaaug

SEQ ID NO: 138816 - RNA, 20 nt, Artificial Sequence
  mmSKRIPTE0009595_Il1f8_6
  gRNA
uuaucccuccaaaucagggc

SEQ ID NO: 138817 - RNA, 20 nt, Artificial Sequence
  mmSKRIPTE0009596_Il1f8_7
  gRNA
ucacugauagaaguaaguca

SEQ ID NO: 138818 - RNA, 20 nt, Artificial Sequence
  mmSKRIPTE0009597_Il1f8_8
  gRNA
guaaaucaccuaagacagaa

SEQ ID NO: 138819 - RNA, 20 nt, Artificial Sequence
  mmSKRIPTE0009598_Il1f8_9
  gRNA
gacuggacuuaguagcugga

SEQ ID NO: 138820 - RNA, 20 nt, Artificial Sequence
  mmSKRIPTE0009599_Arf6_1
  gRNA
ucuggcggcauuacuacacc

SEQ ID NO: 138821 - RNA, 20 nt, Artificial Sequence
  mmSKRIPTE0009600_Arf6_2
  gRNA
cuaccacgaagaucagaccc

SEQ ID NO: 138822 - RNA, 20 nt, Artificial Sequence
  mmSKRIPTE0009601_Arf6_3
  gRNA
cuugugacuuccagcaaacg

SEQ ID NO: 138823 - RNA, 20 nt, Artificial Sequence
  mmSKRIPTE0009602_Arf6_4
  gRNA
gucaggucauggauccucgc

SEQ ID NO: 138824 - RNA, 20 nt, Artificial Sequence
  mmSKRIPTE0009603_Arf6_5
  gRNA
uagcaccuuccccaucgcgu

SEQ ID NO: 138825 - RNA, 20 nt, Artificial Sequence
  mmSKRIPTE0009604_Arf6_6
  gRNA
gggagaagggaguuaccgcc

SEQ ID NO: 138826 - RNA, 20 nt, Artificial Sequence
  mmSKRIPTE0009605_Arf6_7
  gRNA
cucgccucgcuugagcaggg

SEQ ID NO: 138827 - RNA, 20 nt, Artificial Sequence
  mmSKRIPTE0009606_Arf6_8
  gRNA
ugcuaaaguuagcgcuaagg

SEQ ID NO: 138828 - RNA, 20 nt, Artificial Sequence
  mmSKRIPTE0009607_Arf6_9
  gRNA
cauccuaacgcaaagccaag

SEQ ID NO: 138829 - RNA, 20 nt, Artificial Sequence
  mmSKRIPTE0009608_Tkfc_1
  gRNA
guguggcaaauggccucacu

SEQ ID NO: 138830 - RNA, 20 nt, Artificial Sequence
  mmSKRIPTE0009609_Tkfc_2
  gRNA
gguaccucacacuagcacug

SEQ ID NO: 138831 - RNA, 20 nt, Artificial Sequence
  mmSKRIPTE0009610_Tkfc_3
  gRNA
caccacccucaucggacugg

SEQ ID NO: 138832 - RNA, 20 nt, Artificial Sequence
  mmSKRIPTE0009611_Tkfc_4
  gRNA
agucaggaccguccacccgg

SEQ ID NO: 138833 - RNA, 20 nt, Artificial Sequence
  mmSKRIPTE0009612_Tkfc_5
  gRNA
ggucuccaggauggaacgug

SEQ ID NO: 138834 - RNA, 20 nt, Artificial Sequence
  mmSKRIPTE0009613_Tkfc_6
  gRNA
ucuaggucuguuaucccugg

SEQ ID NO: 138835 - RNA, 20 nt, Artificial Sequence
  mmSKRIPTE0009614_Tkfc_7
  gRNA
ccaugcuacuguuccuacag

SEQ ID NO: 138836 - RNA, 20 nt, Artificial Sequence
  mmSKRIPTE0009615_Tkfc_8
  gRNA
ggguauaggaggccuuccag

SEQ ID NO: 138837 - RNA, 20 nt, Artificial Sequence
  mmSKRIPTE0009616_Tkfc_9
  gRNA
gagucuagagaccaccugag

SEQ ID NO: 138838 - RNA, 20 nt, Artificial Sequence
  mmSKRIPTE0009617_Ighv8-4_1
  gRNA
gaaagugcaaguaagucuga

SEQ ID NO: 138839 - RNA, 20 nt, Artificial Sequence
  mmSKRIPTE0009618_Ighv8-4_2
  gRNA
ugagugucagggauuccuaa

SEQ ID NO: 138840 - RNA, 20 nt, Artificial Sequence
  mmSKRIPTE0009619_Ighv8-4_3
  gRNA
gaacaucugaaaagugaccu

SEQ ID NO: 138841 - RNA, 20 nt, Artificial Sequence
  mmSKRIPTE0009620_Ighv8-4_4
  gRNA
auuccugaauaucaucacug

SEQ ID NO: 138842 - RNA, 20 nt, Artificial Sequence
  mmSKRIPTE0009621_Ighv8-4_5
  gRNA
ucuuuagagauggguuguag

SEQ ID NO: 138843 - RNA, 20 nt, Artificial Sequence
  mmSKRIPTE0009622_Ighv8-4_6
  gRNA
ugaagacauaagccugucca

SEQ ID NO: 138844 - RNA, 20 nt, Artificial Sequence
  mmSKRIPTE0009623_Ighv8-4_7
  gRNA
agacuguuucagaguaaucu

SEQ ID NO: 138845 - RNA, 20 nt, Artificial Sequence
  mmSKRIPTE0009624_Ighv8-4_8
  gRNA
guggcuggcaaccauuuggu

SEQ ID NO: 138846 - RNA, 20 nt, Artificial Sequence
  mmSKRIPTE0009625_Ighv8-4_9
  gRNA
gguaaguuuagaauagagug

SEQ ID NO: 138847 - RNA, 20 nt, Artificial Sequence
  mmSKRIPTE0009626_Fcer1a_1
  gRNA
guaacgcaagguacguucca

SEQ ID NO: 138848 - RNA, 20 nt, Artificial Sequence
  mmSKRIPTE0009627_Fcer1a_2
  gRNA
uggccucucuaauggagacg

SEQ ID NO: 138849 - RNA, 20 nt, Artificial Sequence
  mmSKRIPTE0009628_Fcer1a_3
  gRNA
ggccaggcgauaaacaagag

SEQ ID NO: 138850 - RNA, 20 nt, Artificial Sequence
  mmSKRIPTE0009629_Fcer1a_4
  gRNA
ccacaaugguaccgucucug

SEQ ID NO: 138851 - RNA, 20 nt, Artificial Sequence
  mmSKRIPTE0009630_Fcer1a_5
  gRNA
uguuugaaguuaguacaaca

SEQ ID NO: 138852 - RNA, 20 nt, Artificial Sequence
  mmSKRIPTE0009631_Fcer1a_6
  gRNA
agugccaccguucaagacag

SEQ ID NO: 138853 - RNA, 20 nt, Artificial Sequence
  mmSKRIPTE0009632_Fcer1a_7
  gRNA
gcucucuagaccacuguaga

SEQ ID NO: 138854 - RNA, 20 nt, Artificial Sequence
  mmSKRIPTE0009633_Fcer1a_8
  gRNA
aaaauguccagauacacugg

SEQ ID NO: 138855 - RNA, 20 nt, Artificial Sequence
  mmSKRIPTE0009634_Fcer1a_9
  gRNA
gagcuauaggaaaacacgau

SEQ ID NO: 138856 - RNA, 20 nt, Artificial Sequence
  mmSKRIPTE0009635_Ighd_1
  gRNA
caugauacacgaguguugga

SEQ ID NO: 138857 - RNA, 20 nt, Artificial Sequence
  mmSKRIPTE0009636_Ighd_2
  gRNA
aagugauaaguauuagcggg

SEQ ID NO: 138858 - RNA, 20 nt, Artificial Sequence
  mmSKRIPTE0009637_Ighd_3
  gRNA
agagccgugaagucauacag

SEQ ID NO: 138859 - RNA, 20 nt, Artificial Sequence
  mmSKRIPTE0009638_Ighd_4
  gRNA
ugagagaucagaguauuccg

SEQ ID NO: 138860 - RNA, 20 nt, Artificial Sequence
  mmSKRIPTE0009639_Ighd_5
  gRNA
acccaucgguacuucuggag

SEQ ID NO: 138861 - RNA, 20 nt, Artificial Sequence
  mmSKRIPTE0009640_Ighd_6
  gRNA
uaucccuggaccaugcagaa

SEQ ID NO: 138862 - RNA, 20 nt, Artificial Sequence
  mmSKRIPTE0009641_Ighd_7
  gRNA
uagaggaggagaacggccug

SEQ ID NO: 138863 - RNA, 20 nt, Artificial Sequence
  mmSKRIPTE0009642_Ighd_8
  gRNA
gcaaaggcacuagcuaugca

SEQ ID NO: 138864 - RNA, 20 nt, Artificial Sequence
  mmSKRIPTE0009643_Ighd_9
  gRNA
uucgucaccuucaucaaggu

SEQ ID NO: 138865 - RNA, 20 nt, Artificial Sequence
  mmSKRIPTE0009644_Cav1_1
  gRNA
uuucugacaccagacccgca

SEQ ID NO: 138866 - RNA, 20 nt, Artificial Sequence
  mmSKRIPTE0009645_Cav1_2
  gRNA
gcucucugccugguaccgag

SEQ ID NO: 138867 - RNA, 20 nt, Artificial Sequence
  mmSKRIPTE0009646_Cav1_3
  gRNA
gcacucagguggacuaaacg

SEQ ID NO: 138868 - RNA, 20 nt, Artificial Sequence
  mmSKRIPTE0009647_Cav1_4
  gRNA
agucagggccgagagccgug

SEQ ID NO: 138869 - RNA, 20 nt, Artificial Sequence
  mmSKRIPTE0009648_Cav1_5
  gRNA
uuugcuagcuucaaccucga

SEQ ID NO: 138870 - RNA, 20 nt, Artificial Sequence
  mmSKRIPTE0009649_Cav1_6
  gRNA
acuguucccauccgggaaca

SEQ ID NO: 138871 - RNA, 20 nt, Artificial Sequence
  mmSKRIPTE0009650_Cav1_7
  gRNA
aguguaugacgcgcacacca

SEQ ID NO: 138872 - RNA, 20 nt, Artificial Sequence
  mmSKRIPTE0009651_Cav1_8
  gRNA
aagcuugggagaguacacug

SEQ ID NO: 138873 - RNA, 20 nt, Artificial Sequence
  mmSKRIPTE0009652_Cav1_9
  gRNA
aaagcacgggugggucaccg

SEQ ID NO: 138874 - RNA, 20 nt, Artificial Sequence
  mmSKRIPTE0009653_Ccl25_1
  gRNA
uggcugcauaaagugccuca

SEQ ID NO: 138875 - RNA, 20 nt, Artificial Sequence
  mmSKRIPTE0009654_Ccl25_2
  gRNA
accccaacaguacaagcgug

SEQ ID NO: 138876 - RNA, 20 nt, Artificial Sequence
  mmSKRIPTE0009655_Ccl25_3
  gRNA
gguaaagacucuugagcacg

SEQ ID NO: 138877 - RNA, 20 nt, Artificial Sequence
  mmSKRIPTE0009656_Ccl25_4
  gRNA
aggcaauacacgcuacaagc

SEQ ID NO: 138878 - RNA, 20 nt, Artificial Sequence
  mmSKRIPTE0009657_Ccl25_5
  gRNA
gcugcaaccuacgugcugug

SEQ ID NO: 138879 - RNA, 20 nt, Artificial Sequence
  mmSKRIPTE0009658_Ccl25_6
  gRNA
gcggaaguagaaucuacaga

SEQ ID NO: 138880 - RNA, 20 nt, Artificial Sequence
  mmSKRIPTE0009659_Ccl25_7
  gRNA
aaagcaauaugcccaaaccg

SEQ ID NO: 138881 - RNA, 20 nt, Artificial Sequence
  mmSKRIPTE0009660_Ccl25_8
  gRNA
gagugccaaguuaggacaug

SEQ ID NO: 138882 - RNA, 20 nt, Artificial Sequence
  mmSKRIPTE0009661_Ccl25_9
  gRNA
uaaccuucacuaugaaacug

SEQ ID NO: 138883 - RNA, 20 nt, Artificial Sequence
  mmSKRIPTE0009662_Ccl8_1
  gRNA
caacaauauccagugcccca

SEQ ID NO: 138884 - RNA, 20 nt, Artificial Sequence
  mmSKRIPTE0009663_Ccl8_2
  gRNA
cucccuauguggguaaggcg

SEQ ID NO: 138885 - RNA, 20 nt, Artificial Sequence
  mmSKRIPTE0009664_Ccl8_3
  gRNA
ccacuccaucucuaguaaca

SEQ ID NO: 138886 - RNA, 20 nt, Artificial Sequence
  mmSKRIPTE0009665_Ccl8_4
  gRNA
cccucaucuucccuuaugag

SEQ ID NO: 138887 - RNA, 20 nt, Artificial Sequence
  mmSKRIPTE0009666_Ccl8_5
  gRNA
agacccuagauacaaaacuu

SEQ ID NO: 138888 - RNA, 20 nt, Artificial Sequence
  mmSKRIPTE0009667_Ccl8_6
  gRNA
aauggggucugucgagcugu

SEQ ID NO: 138889 - RNA, 20 nt, Artificial Sequence
  mmSKRIPTE0009668_Ccl8_7
  gRNA
cucugccuggagaagauuag

SEQ ID NO: 138890 - RNA, 20 nt, Artificial Sequence
  mmSKRIPTE0009669_Ccl8_8
  gRNA
aucuaacucugcuagucugg

SEQ ID NO: 138891 - RNA, 20 nt, Artificial Sequence
  mmSKRIPTE0009670_Ccl8_9
  gRNA
augauuucccggcagcugga

SEQ ID NO: 138892 - RNA, 20 nt, Artificial Sequence
  mmSKRIPTE0009671_H2-D1_1
  gRNA
cucggacugacaguuaacgu

SEQ ID NO: 138893 - RNA, 20 nt, Artificial Sequence
  mmSKRIPTE0009672_H2-D1_2
  gRNA
ccuccucaccaaaccccggg

SEQ ID NO: 138894 - RNA, 20 nt, Artificial Sequence
  mmSKRIPTE0009673_H2-D1_3
  gRNA
ccgggacacugaugacgcgc

SEQ ID NO: 138895 - RNA, 20 nt, Artificial Sequence
  mmSKRIPTE0009674_H2-D1_4
  gRNA
agauguaccggggcuccucg

SEQ ID NO: 138896 - RNA, 20 nt, Artificial Sequence
  mmSKRIPTE0009675_H2-D1_5
  gRNA
ucugugauggggccacaccu

SEQ ID NO: 138897 - RNA, 20 nt, Artificial Sequence
  mmSKRIPTE0009676_H2-D1_6
  gRNA
aaaauggacugagcccaccu

SEQ ID NO: 138898 - RNA, 20 nt, Artificial Sequence
  mmSKRIPTE0009677_H2-D1_7
  gRNA
ggagccaaucagcgucgccg

SEQ ID NO: 138899 - RNA, 20 nt, Artificial Sequence
  mmSKRIPTE0009678_H2-D1_8
  gRNA
cgacgcaagugggagcagag

SEQ ID NO: 138900 - RNA, 20 nt, Artificial Sequence
  mmSKRIPTE0009679_H2-D1_9
  gRNA
ccuccagagaaaucuucuag

SEQ ID NO: 138901 - RNA, 20 nt, Artificial Sequence
  mmSKRIPTE0009680_H2-M10.4_1
  gRNA
aagacgaacucuuauauaca

SEQ ID NO: 138902 - RNA, 20 nt, Artificial Sequence
  mmSKRIPTE0009681_H2-M10.4_2
  gRNA
gcuuacugggccagaccgug

SEQ ID NO: 138903 - RNA, 20 nt, Artificial Sequence
  mmSKRIPTE0009682_H2-M10.4_3
  gRNA
acagcagaucagagacugcg

SEQ ID NO: 138904 - RNA, 20 nt, Artificial Sequence
  mmSKRIPTE0009683_H2-M10.4_4
  gRNA
uuuaauccagaccggacgca

SEQ ID NO: 138905 - RNA, 20 nt, Artificial Sequence
  mmSKRIPTE0009684_H2-M10.4_5
  gRNA
uacaggcuguuaccugagua

SEQ ID NO: 138906 - RNA, 20 nt, Artificial Sequence
  mmSKRIPTE0009685_H2-M10.4_6
  gRNA
cacccaccuucacaauacug

SEQ ID NO: 138907 - RNA, 20 nt, Artificial Sequence
  mmSKRIPTE0009686_H2-M10.4_7
  gRNA
gcuguacaacuggugccaag

SEQ ID NO: 138908 - RNA, 20 nt, Artificial Sequence
  mmSKRIPTE0009687_H2-M10.4_8
  gRNA
gcucccuacaaaccuacucu

SEQ ID NO: 138909 - RNA, 20 nt, Artificial Sequence
  mmSKRIPTE0009688_H2-M10.4_9
  gRNA
ugagcccguagugaccacca

SEQ ID NO: 138910 - RNA, 20 nt, Artificial Sequence
  mmSKRIPTE0009689_Pde4b_1
  gRNA
ugaaacccggaauuguacga

SEQ ID NO: 138911 - RNA, 20 nt, Artificial Sequence
  mmSKRIPTE0009690_Pde4b_2
  gRNA
gcauacaugaugcacguaag

SEQ ID NO: 138912 - RNA, 20 nt, Artificial Sequence
  mmSKRIPTE0009691_Pde4b_3
  gRNA
cucacgcuucggagucaaca

SEQ ID NO: 138913 - RNA, 20 nt, Artificial Sequence
  mmSKRIPTE0009692_Pde4b_4
  gRNA
uguguccaccaaaucugaug

SEQ ID NO: 138914 - RNA, 20 nt, Artificial Sequence
  mmSKRIPTE0009693_Pde4b_5
  gRNA
cucccaacuagaguaaaaug

SEQ ID NO: 138915 - RNA, 20 nt, Artificial Sequence
  mmSKRIPTE0009694_Pde4b_6
  gRNA
gggaguaccacccgucugga

SEQ ID NO: 138916 - RNA, 20 nt, Artificial Sequence
  mmSKRIPTE0009695_Pde4b_7
  gRNA
gaaugcuauugcaugcacgc

SEQ ID NO: 138917 - RNA, 20 nt, Artificial Sequence
  mmSKRIPTE0009696_Pde4b_8
  gRNA
auggaccgaucguaucaugg

SEQ ID NO: 138918 - RNA, 20 nt, Artificial Sequence
  mmSKRIPTE0009697_Pde4b_9
  gRNA
gggccuuaacaucuucaaug

SEQ ID NO: 138919 - RNA, 20 nt, Artificial Sequence
  mmSKRIPTE0009698_Mir301_1
  gRNA
aaaggugugcaaccugcucg

SEQ ID NO: 138920 - RNA, 20 nt, Artificial Sequence
  mmSKRIPTE0009699_Mir301_2
  gRNA
uuccugcucacuccugcuaa

SEQ ID NO: 138921 - RNA, 20 nt, Artificial Sequence
  mmSKRIPTE0009700_Mir301_3
  gRNA
gguuucuauaacuuucagug

SEQ ID NO: 138922 - RNA, 20 nt, Artificial Sequence
  mmSKRIPTE0009701_Mir301_4
  gRNA
uacuguacgcugugaaguaa

SEQ ID NO: 138923 - RNA, 20 nt, Artificial Sequence
  mmSKRIPTE0009702_Mir301_5
  gRNA
acaaaaaccaauuaucacuu

SEQ ID NO: 138924 - RNA, 20 nt, Artificial Sequence
  mmSKRIPTE0009703_Ighv1-12_1
  gRNA
uaccaguuacaauaugcacu

SEQ ID NO: 138925 - RNA, 20 nt, Artificial Sequence
  mmSKRIPTE0009704_Ighv1-12_2
  gRNA
agacugcuguagauaagccu

SEQ ID NO: 138926 - RNA, 20 nt, Artificial Sequence
  mmSKRIPTE0009705_Ighv1-12_3
  gRNA
aaagauccugcugaauccca

SEQ ID NO: 138927 - RNA, 20 nt, Artificial Sequence
  mmSKRIPTE0009706_Ighv1-12_4
  gRNA
guaaagcagacaccuagaca

SEQ ID NO: 138928 - RNA, 20 nt, Artificial Sequence
  mmSKRIPTE0009707_Ighv1-12_5
  gRNA
ugggaguggacaccuauaga

SEQ ID NO: 138929 - RNA, 20 nt, Artificial Sequence
  mmSKRIPTE0009708_Ighv1-12_6
  gRNA
cuauuucuaaguaaaucuac

SEQ ID NO: 138930 - RNA, 20 nt, Artificial Sequence
  mmSKRIPTE0009709_Ighv1-12_7
  gRNA
caccaguuccaaauauuaag

SEQ ID NO: 138931 - RNA, 20 nt, Artificial Sequence
  mmSKRIPTE0009710_Ighv1-12_8
  gRNA
uauggaaugcagauuauuga

SEQ ID NO: 138932 - RNA, 20 nt, Artificial Sequence
  mmSKRIPTE0009711_Tslp_1
  gRNA
acagagaaaugacgguacuc

SEQ ID NO: 138933 - RNA, 20 nt, Artificial Sequence
  mmSKRIPTE0009712_Tslp_2
  gRNA
uaaaaguggggcuuuaagug

SEQ ID NO: 138934 - RNA, 20 nt, Artificial Sequence
  mmSKRIPTE0009713_Tslp_3
  gRNA
gggcagucacugccaugaug

SEQ ID NO: 138935 - RNA, 20 nt, Artificial Sequence
  mmSKRIPTE0009714_Tslp_4
  gRNA
gccuuugcaaugaaugacug

SEQ ID NO: 138936 - RNA, 20 nt, Artificial Sequence
  mmSKRIPTE0009715_Tslp_5
  gRNA
uuauucuggagauugcauga

SEQ ID NO: 138937 - RNA, 20 nt, Artificial Sequence
  mmSKRIPTE0009716_Tslp_6
  gRNA
auauaucucguagaugugca

SEQ ID NO: 138938 - RNA, 20 nt, Artificial Sequence
  mmSKRIPTE0009717_Tslp_7
  gRNA
ggaaaacggaaucaacccac

SEQ ID NO: 138939 - RNA, 20 nt, Artificial Sequence
  mmSKRIPTE0009718_Tslp_8
  gRNA
gauugcaugugcuucuccag

SEQ ID NO: 138940 - RNA, 20 nt, Artificial Sequence
  mmSKRIPTE0009719_Tslp_9
  gRNA
ccugcacacaccuuacucua

SEQ ID NO: 138941 - RNA, 20 nt, Artificial Sequence
  mmSKRIPTE0009720_Mecom_1
  gRNA
acauucuuccaguagccgag

SEQ ID NO: 138942 - RNA, 20 nt, Artificial Sequence
  mmSKRIPTE0009721_Mecom_2
  gRNA
ucaaugcucauuaggucacg

SEQ ID NO: 138943 - RNA, 20 nt, Artificial Sequence
  mmSKRIPTE0009722_Mecom_3
  gRNA
gagaucgaaugugucgcuga

SEQ ID NO: 138944 - RNA, 20 nt, Artificial Sequence
  mmSKRIPTE0009723_Mecom_4
  gRNA
agcuguccaugacacgauag

SEQ ID NO: 138945 - RNA, 20 nt, Artificial Sequence
  mmSKRIPTE0009724_Mecom_5
  gRNA
gauuaaaccucauaaucaca

SEQ ID NO: 138946 - RNA, 20 nt, Artificial Sequence
  mmSKRIPTE0009725_Mecom_6
  gRNA
aguuugacaaguuugcucgg

SEQ ID NO: 138947 - RNA, 20 nt, Artificial Sequence
  mmSKRIPTE0009726_Mecom_7
  gRNA
cuguuugaggccugacgaag

SEQ ID NO: 138948 - RNA, 20 nt, Artificial Sequence
  mmSKRIPTE0009727_Mecom_8
  gRNA
gcgcacaugucgcugcaggu

SEQ ID NO: 138949 - RNA, 20 nt, Artificial Sequence
  mmSKRIPTE0009728_Mecom_9
  gRNA
gcaugcgcuuaugacgacaa

SEQ ID NO: 138950 - RNA, 20 nt, Artificial Sequence
  mmSKRIPTE0009729_S100a9_1
  gRNA
caaccuaggagggcuucaag

SEQ ID NO: 138951 - RNA, 20 nt, Artificial Sequence
  mmSKRIPTE0009730_S100a9_2
  gRNA
aaaaugaagcuuacuuacca

SEQ ID NO: 138952 - RNA, 20 nt, Artificial Sequence
  mmSKRIPTE0009731_S100a9_3
  gRNA
aauguguggugcccuauuug

SEQ ID NO: 138953 - RNA, 20 nt, Artificial Sequence
  mmSKRIPTE0009732_S100a9_4
  gRNA
cuguuaggcaagauaaggag

SEQ ID NO: 138954 - RNA, 20 nt, Artificial Sequence
  mmSKRIPTE0009733_S100a9_5
  gRNA
agaacaaauucuagcaccgg

SEQ ID NO: 138955 - RNA, 20 nt, Artificial Sequence
  mmSKRIPTE0009734_S100a9_6
  gRNA
ugcaugagaacaacccacgu

SEQ ID NO: 138956 - RNA, 20 nt, Artificial Sequence
  mmSKRIPTE0009735_S100a9_7
  gRNA
uuagauacaugguuaucucg

SEQ ID NO: 138957 - RNA, 20 nt, Artificial Sequence
  mmSKRIPTE0009736_S100a9_8
  gRNA
cuuccuagaguauugaugga

SEQ ID NO: 138958 - RNA, 20 nt, Artificial Sequence
  mmSKRIPTE0009737_S100a9_9
  gRNA
caaggauagagacacgguga

SEQ ID NO: 138959 - RNA, 20 nt, Artificial Sequence
  mmSKRIPTE0009738_Raet1a_1
  gRNA
gaugaagugaagugcuucgu

SEQ ID NO: 138960 - RNA, 20 nt, Artificial Sequence
  mmSKRIPTE0009739_Raet1a_2
  gRNA
aaucccucuggaaacaacga

SEQ ID NO: 138961 - RNA, 20 nt, Artificial Sequence
  mmSKRIPTE0009740_Raet1a_3
  gRNA
cuggcuggagaaccacccgg

SEQ ID NO: 138962 - RNA, 20 nt, Artificial Sequence
  mmSKRIPTE0009741_Raet1a_4
  gRNA
ucagucuacauaguguugga

SEQ ID NO: 138963 - RNA, 20 nt, Artificial Sequence
  mmSKRIPTE0009742_Raet1a_5
  gRNA
gagguuacucacaggauuug

SEQ ID NO: 138964 - RNA, 20 nt, Artificial Sequence
  mmSKRIPTE0009743_Raet1a_6
  gRNA
acagccuucggaagcaagcg

SEQ ID NO: 138965 - RNA, 20 nt, Artificial Sequence
  mmSKRIPTE0009744_Raet1a_7
  gRNA
cuggauucuuacauaaacag

SEQ ID NO: 138966 - RNA, 20 nt, Artificial Sequence
  mmSKRIPTE0009745_Raet1a_8
  gRNA
gaacucaccaucuagcccgu

SEQ ID NO: 138967 - RNA, 20 nt, Artificial Sequence
  mmSKRIPTE0009746_Raet1a_9
  gRNA
ucuacacagagauuaugagc

SEQ ID NO: 138968 - RNA, 20 nt, Artificial Sequence
  mmSKRIPTE0009747_Ighv5-17_1
  gRNA
cugucagagcuacagacucg

SEQ ID NO: 138969 - RNA, 20 nt, Artificial Sequence
  mmSKRIPTE0009748_Ighv5-17_2
  gRNA
uagagagaauuccuuuagcg

SEQ ID NO: 138970 - RNA, 20 nt, Artificial Sequence
  mmSKRIPTE0009749_Ighv5-17_3
  gRNA
cagugacuauggaaugcacu

SEQ ID NO: 138971 - RNA, 20 nt, Artificial Sequence
  mmSKRIPTE0009750_Ighv5-17_4
  gRNA
uuacagugcuugacuaucug

SEQ ID NO: 138972 - RNA, 20 nt, Artificial Sequence
  mmSKRIPTE0009751_Ighv5-17_5
  gRNA
ggucccaagugaccugcagg

SEQ ID NO: 138973 - RNA, 20 nt, Artificial Sequence
  mmSKRIPTE0009752_Ighv5-17_6
  gRNA
ggcugcaagucucacuaacu

SEQ ID NO: 138974 - RNA, 20 nt, Artificial Sequence
  mmSKRIPTE0009753_Ighv5-17_7
  gRNA
gaugucuuacaucuacuaug

SEQ ID NO: 138975 - RNA, 20 nt, Artificial Sequence
  mmSKRIPTE0009754_Ighv5-17_8
  gRNA
ucucccuguugugugcacau

SEQ ID NO: 138976 - RNA, 20 nt, Artificial Sequence
  mmSKRIPTE0009755_Ighv5-17_9
  gRNA
aaggaaaacuaaauugagcc

SEQ ID NO: 138977 - RNA, 20 nt, Artificial Sequence
  mmSKRIPTE0009756_Ighv11-2_1
  gRNA
gcagaugagcaaugugcgau

SEQ ID NO: 138978 - RNA, 20 nt, Artificial Sequence
  mmSKRIPTE0009757_Ighv11-2_2
  gRNA
gcacaguccacgcagaacag

SEQ ID NO: 138979 - RNA, 20 nt, Artificial Sequence
  mmSKRIPTE0009758_Ighv11-2_3
  gRNA
guggacugugcacccccuag

SEQ ID NO: 138980 - RNA, 20 nt, Artificial Sequence
  mmSKRIPTE0009759_Ighv11-2_4
  gRNA
gguuuaugucuaguuucaca

SEQ ID NO: 138981 - RNA, 20 nt, Artificial Sequence
  mmSKRIPTE0009760_Ighv11-2_5
  gRNA
gugaaucgauccuuuaugga

SEQ ID NO: 138982 - RNA, 20 nt, Artificial Sequence
  mmSKRIPTE0009761_Ighv11-2_6
  gRNA
gauauauagugggagacaag

SEQ ID NO: 138983 - RNA, 20 nt, Artificial Sequence
  mmSKRIPTE0009762_Ighv11-2_7
  gRNA
gacaugaauaugaggaacaa

SEQ ID NO: 138984 - RNA, 20 nt, Artificial Sequence
  mmSKRIPTE0009763_Ighv11-2_8
  gRNA
cucuuacucacuucucaaca

SEQ ID NO: 138985 - RNA, 20 nt, Artificial Sequence
  mmSKRIPTE0009764_Ighv11-2_9
  gRNA
gcagaacagugguucagacc

SEQ ID NO: 138986 - RNA, 20 nt, Artificial Sequence
  mmSKRIPTE0009765_Ppp1r14b_1
  gRNA
agcggcgagugcaagaccgg

SEQ ID NO: 138987 - RNA, 20 nt, Artificial Sequence
  mmSKRIPTE0009766_Ppp1r14b_2
  gRNA
gcuagggucaagguaagcug

SEQ ID NO: 138988 - RNA, 20 nt, Artificial Sequence
  mmSKRIPTE0009767_Ppp1r14b_3
  gRNA
agaaggcccaggaucaccug

SEQ ID NO: 138989 - RNA, 20 nt, Artificial Sequence
  mmSKRIPTE0009768_Ppp1r14b_4
  gRNA
auugcuauuccaagcagcug

SEQ ID NO: 138990 - RNA, 20 nt, Artificial Sequence
  mmSKRIPTE0009769_Ppp1r14b_5
  gRNA
cccuaaaaucggcccuaagu

SEQ ID NO: 138991 - RNA, 20 nt, Artificial Sequence
  mmSKRIPTE0009770_Ppp1r14b_6
  gRNA
uagggccaagccuccccaag

SEQ ID NO: 138992 - RNA, 20 nt, Artificial Sequence
  mmSKRIPTE0009771_Ppp1r14b_7
  gRNA
gcagcuuaucaucgggaucc

SEQ ID NO: 138993 - RNA, 20 nt, Artificial Sequence
  mmSKRIPTE0009772_Ppp1r14b_8
  gRNA
gcaguaccacgaaggacgca

SEQ ID NO: 138994 - RNA, 20 nt, Artificial Sequence
  mmSKRIPTE0009773_Ppp1r14b_9
  gRNA
cuccugaaaggggauagggg

SEQ ID NO: 138995 - RNA, 20 nt, Artificial Sequence
  mmSKRIPTE0009774_Trbc1_1
  gRNA
aacagcauccuaucaacaag

SEQ ID NO: 138996 - RNA, 20 nt, Artificial Sequence
  mmSKRIPTE0009775_Trbc1_2
  gRNA
ugaagauuaagccaaucuag

SEQ ID NO: 138997 - RNA, 20 nt, Artificial Sequence
  mmSKRIPTE0009776_Trbc1_3
  gRNA
uaggccucuuccagaaguag

SEQ ID NO: 138998 - RNA, 20 nt, Artificial Sequence
  mmSKRIPTE0009777_Trbc1_4
  gRNA
acuguaguggauagcuauag

SEQ ID NO: 138999 - RNA, 20 nt, Artificial Sequence
  mmSKRIPTE0009778_Trbc1_5
  gRNA
ucuacagucauaaucaugag

SEQ ID NO: 139000 - RNA, 20 nt, Artificial Sequence
  mmSKRIPTE0009779_Trbc1_6
  gRNA
acccaggcauuuacaaccag

SEQ ID NO: 139001 - RNA, 20 nt, Artificial Sequence
  mmSKRIPTE0009780_Trbc1_7
  gRNA
ggcagauggagcuuaugggg

SEQ ID NO: 139002 - RNA, 20 nt, Artificial Sequence
  mmSKRIPTE0009781_Trbc1_8
  gRNA
cuggggccgagcagguaagu

SEQ ID NO: 139003 - RNA, 20 nt, Artificial Sequence
  mmSKRIPTE0009782_Trbc1_9
  gRNA
gacaagcacagcauacaggg

SEQ ID NO: 139004 - RNA, 20 nt, Artificial Sequence
  mmSKRIPTE0009783_Il15_1
  gRNA
aggucuucacucuucagcgu

SEQ ID NO: 139005 - RNA, 20 nt, Artificial Sequence
  mmSKRIPTE0009784_Il15_2
  gRNA
ugguggugguggaucaacaa

SEQ ID NO: 139006 - RNA, 20 nt, Artificial Sequence
  mmSKRIPTE0009785_Il15_3
  gRNA
gacgugcaaauccuuaacug

SEQ ID NO: 139007 - RNA, 20 nt, Artificial Sequence
  mmSKRIPTE0009786_Il15_4
  gRNA
gaaacacaaguagcacgaga

SEQ ID NO: 139008 - RNA, 20 nt, Artificial Sequence
  mmSKRIPTE0009787_Il15_5
  gRNA
uguaggucucccuaaaacag

SEQ ID NO: 139009 - RNA, 20 nt, Artificial Sequence
  mmSKRIPTE0009788_Il15_6
  gRNA
ucuuaaggaccucaccagca

SEQ ID NO: 139010 - RNA, 20 nt, Artificial Sequence
  mmSKRIPTE0009789_Il15_7
  gRNA
cagagggccaugugucaagg

SEQ ID NO: 139011 - RNA, 20 nt, Artificial Sequence
  mmSKRIPTE0009790_Il15_8
  gRNA
gagaguauggcacauaacau

SEQ ID NO: 139012 - RNA, 20 nt, Artificial Sequence
  mmSKRIPTE0009791_Il15_9
  gRNA
gggguuggguauucguacgu

SEQ ID NO: 139013 - RNA, 20 nt, Artificial Sequence
  mmSKRIPTE0009792_H2-M1_1
  gRNA
uagccgagaaagauuaacug

SEQ ID NO: 139014 - RNA, 20 nt, Artificial Sequence
  mmSKRIPTE0009793_H2-M1_2
  gRNA
uguaaacucaggauacggau

SEQ ID NO: 139015 - RNA, 20 nt, Artificial Sequence
  mmSKRIPTE0009794_H2-M1_3
  gRNA
agcauggaugcagcacauag

SEQ ID NO: 139016 - RNA, 20 nt, Artificial Sequence
  mmSKRIPTE0009795_H2-M1_4
  gRNA
gaacuuggauuugaacgaca

SEQ ID NO: 139017 - RNA, 20 nt, Artificial Sequence
  mmSKRIPTE0009796_H2-M1_5
  gRNA
aguagcgucugugcaugacu

SEQ ID NO: 139018 - RNA, 20 nt, Artificial Sequence
  mmSKRIPTE0009797_H2-M1_6
  gRNA
cucagccaauuguacaagga

SEQ ID NO: 139019 - RNA, 20 nt, Artificial Sequence
  mmSKRIPTE0009798_H2-M1_7
  gRNA
aaauaacaagccuaagcugu

SEQ ID NO: 139020 - RNA, 20 nt, Artificial Sequence
  mmSKRIPTE0009799_H2-M1_8
  gRNA
auagccccucaugauuuacg

SEQ ID NO: 139021 - RNA, 20 nt, Artificial Sequence
  mmSKRIPTE0009800_H2-M1_9
  gRNA
aucuccacacuccaccuagg

SEQ ID NO: 139022 - RNA, 20 nt, Artificial Sequence
  mmSKRIPTE0009801_Clec2g_1
  gRNA
acuaaaaggccucccaccgu

SEQ ID NO: 139023 - RNA, 20 nt, Artificial Sequence
  mmSKRIPTE0009802_Clec2g_2
  gRNA
gaucccauugccgcucaggu

SEQ ID NO: 139024 - RNA, 20 nt, Artificial Sequence
  mmSKRIPTE0009803_Clec2g_3
  gRNA
aaucccguuugauagcacug

SEQ ID NO: 139025 - RNA, 20 nt, Artificial Sequence
  mmSKRIPTE0009804_Clec2g_4
  gRNA
auggcucccaacaugccuag

SEQ ID NO: 139026 - RNA, 20 nt, Artificial Sequence
  mmSKRIPTE0009805_Clec2g_5
  gRNA
gaaacaugugccuaccugag

SEQ ID NO: 139027 - RNA, 20 nt, Artificial Sequence
  mmSKRIPTE0009806_Clec2g_6
  gRNA
guuaucucuagagaaaggug

SEQ ID NO: 139028 - RNA, 20 nt, Artificial Sequence
  mmSKRIPTE0009807_Clec2g_7
  gRNA
uauccgagguauauagugcc

SEQ ID NO: 139029 - RNA, 20 nt, Artificial Sequence
  mmSKRIPTE0009808_Clec2g_8
  gRNA
acugauaggcaauugucaag

SEQ ID NO: 139030 - RNA, 20 nt, Artificial Sequence
  mmSKRIPTE0009809_Clec2g_9
  gRNA
agcagucagucucuuaacua

SEQ ID NO: 139031 - RNA, 20 nt, Artificial Sequence
  mmSKRIPTE0009810_Iigp1_1
  gRNA
cuugaggccucaugagcgug

SEQ ID NO: 139032 - RNA, 20 nt, Artificial Sequence
  mmSKRIPTE0009811_Iigp1_2
  gRNA
gcucaauguugcugucaccg

SEQ ID NO: 139033 - RNA, 20 nt, Artificial Sequence
  mmSKRIPTE0009812_Iigp1_3
  gRNA
acaccccaauauacccaaug

SEQ ID NO: 139034 - RNA, 20 nt, Artificial Sequence
  mmSKRIPTE0009813_Iigp1_4
  gRNA
uuggauagcacacucagaag

SEQ ID NO: 139035 - RNA, 20 nt, Artificial Sequence
  mmSKRIPTE0009814_Iigp1_5
  gRNA
gagaagggaugauauucacu

SEQ ID NO: 139036 - RNA, 20 nt, Artificial Sequence
  mmSKRIPTE0009815_Iigp1_6
  gRNA
aagaguuuacucaaagugag

SEQ ID NO: 139037 - RNA, 20 nt, Artificial Sequence
  mmSKRIPTE0009816_Iigp1_7
  gRNA
ucugaagcagaggauuuggc

SEQ ID NO: 139038 - RNA, 20 nt, Artificial Sequence
  mmSKRIPTE0009817_Iigp1_8
  gRNA
ggucauuaucaagaaucuug

SEQ ID NO: 139039 - RNA, 20 nt, Artificial Sequence
  mmSKRIPTE0009818_Iigp1_9
  gRNA
auucuacuucgugagaacca

SEQ ID NO: 139040 - RNA, 20 nt, Artificial Sequence
  mmSKRIPTE0009819_Gnas_1
  gRNA
cgaccuaaggauuaaccggg

SEQ ID NO: 139041 - RNA, 20 nt, Artificial Sequence
  mmSKRIPTE0009820_Gnas_2
  gRNA
cucggacuaaggcaagcgcg

SEQ ID NO: 139042 - RNA, 20 nt, Artificial Sequence
  mmSKRIPTE0009821_Gnas_3
  gRNA
ccucggcaacaguaagaccg

SEQ ID NO: 139043 - RNA, 20 nt, Artificial Sequence
  mmSKRIPTE0009822_Gnas_4
  gRNA
ccggagaagaaccagcaacg

SEQ ID NO: 139044 - RNA, 20 nt, Artificial Sequence
  mmSKRIPTE0009823_Gnas_5
  gRNA
uccagccuagaacauggacg

SEQ ID NO: 139045 - RNA, 20 nt, Artificial Sequence
  mmSKRIPTE0009824_Gnas_6
  gRNA
cuuuaaaaggggcggcgaag

SEQ ID NO: 139046 - RNA, 20 nt, Artificial Sequence
  mmSKRIPTE0009825_Gnas_7
  gRNA
aaggagcaacagcgaugggu

SEQ ID NO: 139047 - RNA, 20 nt, Artificial Sequence
  mmSKRIPTE0009826_Gnas_8
  gRNA
ugagcgcgaauggagcugca

SEQ ID NO: 139048 - RNA, 20 nt, Artificial Sequence
  mmSKRIPTE0009827_Gnas_9
  gRNA
acuuggcccgggucacgcgu

SEQ ID NO: 139049 - RNA, 20 nt, Artificial Sequence
  mmSKRIPTE0009828_Gm3898_1
  gRNA
auagcuauaguagcuccguu

SEQ ID NO: 139050 - RNA, 20 nt, Artificial Sequence
  mmSKRIPTE0009829_Gm3898_2
  gRNA
gagaugcacaauuugcaggg

SEQ ID NO: 139051 - RNA, 20 nt, Artificial Sequence
  mmSKRIPTE0009830_Gm3898_3
  gRNA
cuuagugagagcuaaccuca

SEQ ID NO: 139052 - RNA, 20 nt, Artificial Sequence
  mmSKRIPTE0009831_Gm3898_4
  gRNA
cagagucgugccgagaacga

SEQ ID NO: 139053 - RNA, 20 nt, Artificial Sequence
  mmSKRIPTE0009832_Gm3898_5
  gRNA
aaaagacuccauuauccccc

SEQ ID NO: 139054 - RNA, 20 nt, Artificial Sequence
  mmSKRIPTE0009833_Gm3898_6
  gRNA
aggugggccuagggcaacac

SEQ ID NO: 139055 - RNA, 20 nt, Artificial Sequence
  mmSKRIPTE0009834_Gm3898_7
  gRNA
cggggcucuugugacaguag

SEQ ID NO: 139056 - RNA, 20 nt, Artificial Sequence
  mmSKRIPTE0009835_Gm3898_8
  gRNA
gagucagaugucagacccgg

SEQ ID NO: 139057 - RNA, 20 nt, Artificial Sequence
  mmSKRIPTE0009836_Gm3898_9
  gRNA
agggacagguccauccugaa

SEQ ID NO: 139058 - RNA, 20 nt, Artificial Sequence
  mmSKRIPTE0009837_Ighv1-47_1
  gRNA
ucacuaccuauccuauagag

SEQ ID NO: 139059 - RNA, 20 nt, Artificial Sequence
  mmSKRIPTE0009838_Ighv1-47_2
  gRNA
uagagauccacgccauugug

SEQ ID NO: 139060 - RNA, 20 nt, Artificial Sequence
  mmSKRIPTE0009839_Ighv1-47_3
  gRNA
ucuauaaucacugagugcag

SEQ ID NO: 139061 - RNA, 20 nt, Artificial Sequence
  mmSKRIPTE0009840_Ighv1-47_4
  gRNA
uaccuauagcuguugccacu

SEQ ID NO: 139062 - RNA, 20 nt, Artificial Sequence
  mmSKRIPTE0009841_Ighv1-47_5
  gRNA
gugugugucaaaaaaccugg

SEQ ID NO: 139063 - RNA, 20 nt, Artificial Sequence
  mmSKRIPTE0009842_Ighv1-47_6
  gRNA
aucauggaaagagccuagag

SEQ ID NO: 139064 - RNA, 20 nt, Artificial Sequence
  mmSKRIPTE0009843_Ighv1-47_7
  gRNA
cuccaaguagacugugcuag

SEQ ID NO: 139065 - RNA, 20 nt, Artificial Sequence
  mmSKRIPTE0009844_Ighv1-47_8
  gRNA
cagagucaucagauguuaau

SEQ ID NO: 139066 - RNA, 20 nt, Artificial Sequence
  mmSKRIPTE0009845_Ighv1-47_9
  gRNA
guagaugucacaugagugua

SEQ ID NO: 139067 - RNA, 20 nt, Artificial Sequence
  mmSKRIPTE0009846_Ulbp1_1
  gRNA
gccccccauaggaaagaaca

SEQ ID NO: 139068 - RNA, 20 nt, Artificial Sequence
  mmSKRIPTE0009847_Ulbp1_2
  gRNA
cacgcauagaauaaucauca

SEQ ID NO: 139069 - RNA, 20 nt, Artificial Sequence
  mmSKRIPTE0009848_Ulbp1_3
  gRNA
gugaguuccugagauucuag

SEQ ID NO: 139070 - RNA, 20 nt, Artificial Sequence
  mmSKRIPTE0009849_Ulbp1_4
  gRNA
cauuuacguacaaaaaaggu

SEQ ID NO: 139071 - RNA, 20 nt, Artificial Sequence
  mmSKRIPTE0009850_Ulbp1_5
  gRNA
caaauggcccaauaaggcug

SEQ ID NO: 139072 - RNA, 20 nt, Artificial Sequence
  mmSKRIPTE0009851_Ulbp1_6
  gRNA
ucucgaauucaugauccagu

SEQ ID NO: 139073 - RNA, 20 nt, Artificial Sequence
  mmSKRIPTE0009852_Ulbp1_7
  gRNA
uugguaaauaguucucacaa

SEQ ID NO: 139074 - RNA, 20 nt, Artificial Sequence
  mmSKRIPTE0009853_Ulbp1_8
  gRNA
aacaaggagcaucauuccag

SEQ ID NO: 139075 - RNA, 20 nt, Artificial Sequence
  mmSKRIPTE0009854_Ulbp1_9
  gRNA
uugccuugaucccccagcca

SEQ ID NO: 139076 - RNA, 20 nt, Artificial Sequence
  mmSKRIPTE0009855_Ighv1-5_1
  gRNA
cuccacaggggucuacucag

SEQ ID NO: 139077 - RNA, 20 nt, Artificial Sequence
  mmSKRIPTE0009856_Ighv1-5_2
  gRNA
acagggucuggaauggauag

SEQ ID NO: 139078 - RNA, 20 nt, Artificial Sequence
  mmSKRIPTE0009857_Ighv1-5_3
  gRNA
gucagaaaacuuggaguggu

SEQ ID NO: 139079 - RNA, 20 nt, Artificial Sequence
  mmSKRIPTE0009858_Ighv1-5_4
  gRNA
gcucagcagccugacaaaug

SEQ ID NO: 139080 - RNA, 20 nt, Artificial Sequence
  mmSKRIPTE0009859_Ighv1-5_5
  gRNA
aucaacuucuccaaauaaag

SEQ ID NO: 139081 - RNA, 20 nt, Artificial Sequence
  mmSKRIPTE0009860_Ighv1-5_6
  gRNA
ucugucgguaacuucaggua

SEQ ID NO: 139082 - RNA, 20 nt, Artificial Sequence
  mmSKRIPTE0009861_Ighv1-5_7
  gRNA
gcuacacauuuaccagcuac

SEQ ID NO: 139083 - RNA, 20 nt, Artificial Sequence
  mmSKRIPTE0009862_Ighv1-5_8
  gRNA
ggaugugacugcagucaguu

SEQ ID NO: 139084 - RNA, 20 nt, Artificial Sequence
  mmSKRIPTE0009863_Ighv1-5_9
  gRNA
auccucuccagauuuggaac

SEQ ID NO: 139085 - RNA, 20 nt, Artificial Sequence
  mmSKRIPTE0009864_H2-M11_1
  gRNA
gaugaagaccuuuguuaccg

SEQ ID NO: 139086 - RNA, 20 nt, Artificial Sequence
  mmSKRIPTE0009865_H2-M11_2
  gRNA
uaugcguugauuguuccccu

SEQ ID NO: 139087 - RNA, 20 nt, Artificial Sequence
  mmSKRIPTE0009866_H2-M11_3
  gRNA
ccguuucugaaauacccucg

SEQ ID NO: 139088 - RNA, 20 nt, Artificial Sequence
  mmSKRIPTE0009867_H2-M11_4
  gRNA
auuuaacagagauacugcaa

SEQ ID NO: 139089 - RNA, 20 nt, Artificial Sequence
  mmSKRIPTE0009868_H2-M11_5
  gRNA
agcaaaucuagguucuggcu

SEQ ID NO: 139090 - RNA, 20 nt, Artificial Sequence
  mmSKRIPTE0009869_H2-M11_6
  gRNA
uaaaugucaugugaaucaug

SEQ ID NO: 139091 - RNA, 20 nt, Artificial Sequence
  mmSKRIPTE0009870_H2-M11_7
  gRNA
uuagauguuaaccccacaag

SEQ ID NO: 139092 - RNA, 20 nt, Artificial Sequence
  mmSKRIPTE0009871_H2-M11_8
  gRNA
ugaaugaggaccuaagcacu

SEQ ID NO: 139093 - RNA, 20 nt, Artificial Sequence
  mmSKRIPTE0009872_H2-M11_9
  gRNA
ccaggaucaggcccuuggag

SEQ ID NO: 139094 - RNA, 20 nt, Artificial Sequence
  mmSKRIPTE0009873_Ighv11-1_1
  gRNA
gaugagcaaugugcgaucug

SEQ ID NO: 139095 - RNA, 20 nt, Artificial Sequence
  mmSKRIPTE0009874_Ighv11-1_2
  gRNA
acauggauaugaggaacacg

SEQ ID NO: 139096 - RNA, 20 nt, Artificial Sequence
  mmSKRIPTE0009875_Ighv11-1_3
  gRNA
uaggccacucugaaccacca

SEQ ID NO: 139097 - RNA, 20 nt, Artificial Sequence
  mmSKRIPTE0009876_Ighv11-1_4
  gRNA
gguauauagugggagccaag

SEQ ID NO: 139098 - RNA, 20 nt, Artificial Sequence
  mmSKRIPTE0009877_Ighv11-1_5
  gRNA
ccuauuauguguuuauaacg

SEQ ID NO: 139099 - RNA, 20 nt, Artificial Sequence
  mmSKRIPTE0009878_Ighv11-1_6
  gRNA
cgcuuacucacgucucaaca

SEQ ID NO: 139100 - RNA, 20 nt, Artificial Sequence
  mmSKRIPTE0009879_Ighv11-1_7
  gRNA
gugaagcgauccuuuaugga

SEQ ID NO: 139101 - RNA, 20 nt, Artificial Sequence
  mmSKRIPTE0009880_Ighv11-1_8
  gRNA
cuggauaagucagauuauga

SEQ ID NO: 139102 - RNA, 20 nt, Artificial Sequence
  mmSKRIPTE0009881_Ighv11-1_9
  gRNA
gguuuaugucuaguuucacc

SEQ ID NO: 139103 - RNA, 20 nt, Artificial Sequence
  mmSKRIPTE0009882_Iglc1_1
  gRNA
ugugaccuucaugagugacc

SEQ ID NO: 139104 - RNA, 20 nt, Artificial Sequence
  mmSKRIPTE0009883_Iglc1_2
  gRNA
uaugguaggcaaaagcacca

SEQ ID NO: 139105 - RNA, 20 nt, Artificial Sequence
  mmSKRIPTE0009884_Iglc1_3
  gRNA
cacugauuucuacccaggug

SEQ ID NO: 139106 - RNA, 20 nt, Artificial Sequence
  mmSKRIPTE0009885_Iglc1_4
  gRNA
cuggaauuuagaguagugug

SEQ ID NO: 139107 - RNA, 20 nt, Artificial Sequence
  mmSKRIPTE0009886_Iglc1_5
  gRNA
cugauggcgaagacuugggc

SEQ ID NO: 139108 - RNA, 20 nt, Artificial Sequence
  mmSKRIPTE0009887_Iglc1_6
  gRNA
guuagucucgagcucuucag

SEQ ID NO: 139109 - RNA, 20 nt, Artificial Sequence
  mmSKRIPTE0009888_Iglc1_7
  gRNA
ugaccuaggaacagucagca

SEQ ID NO: 139110 - RNA, 20 nt, Artificial Sequence
  mmSKRIPTE0009889_Iglc1_8
  gRNA
auaaccugcaucauugcccc

SEQ ID NO: 139111 - RNA, 20 nt, Artificial Sequence
  mmSKRIPTE0009890_Iglc1_9
  gRNA
ucuuucaguagcaauccugg

SEQ ID NO: 139112 - RNA, 20 nt, Artificial Sequence
  mmSKRIPTE0009891_Gm11127_1
  gRNA
agguuaugagugcauaucug

SEQ ID NO: 139113 - RNA, 20 nt, Artificial Sequence
  mmSKRIPTE0009892_Gm11127_2
  gRNA
cuugacccaguauccaagag

SEQ ID NO: 139114 - RNA, 20 nt, Artificial Sequence
  mmSKRIPTE0009893_Gm11127_3
  gRNA
ugcauauccuggauugugug

SEQ ID NO: 139115 - RNA, 20 nt, Artificial Sequence
  mmSKRIPTE0009894_Gm11127_4
  gRNA
aaugauuaccauguuagagu

SEQ ID NO: 139116 - RNA, 20 nt, Artificial Sequence
  mmSKRIPTE0009895_Gm11127_5
  gRNA
aaaaggaggggucuauuguu

SEQ ID NO: 139117 - RNA, 20 nt, Artificial Sequence
  mmSKRIPTE0009896_Gm11127_6
  gRNA
gaccuccucucaaugggcau

SEQ ID NO: 139118 - RNA, 20 nt, Artificial Sequence
  mmSKRIPTE0009897_Gm11127_7
  gRNA
gugagaguccuggaguaccu

SEQ ID NO: 139119 - RNA, 20 nt, Artificial Sequence
  mmSKRIPTE0009898_Gm11127_8
  gRNA
cagcuuuccuacaccuccau

SEQ ID NO: 139120 - RNA, 20 nt, Artificial Sequence
  mmSKRIPTE0009899_Gm11127_9
  gRNA
gagccucgguucaccgccgu

SEQ ID NO: 139121 - RNA, 20 nt, Artificial Sequence
  mmSKRIPTE0009900_Rora_1
  gRNA
aaaauacauccuuuacgccg

SEQ ID NO: 139122 - RNA, 20 nt, Artificial Sequence
  mmSKRIPTE0009901_Rora_2
  gRNA
uuucugguguacaugcgaca

SEQ ID NO: 139123 - RNA, 20 nt, Artificial Sequence
  mmSKRIPTE0009902_Rora_3
  gRNA
gagcuccaguggcuacgcug

SEQ ID NO: 139124 - RNA, 20 nt, Artificial Sequence
  mmSKRIPTE0009903_Rora_4
  gRNA
ccuccgugcaggcucgcuag

SEQ ID NO: 139125 - RNA, 20 nt, Artificial Sequence
  mmSKRIPTE0009904_Rora_5
  gRNA
agucacgagagugaaaacca

SEQ ID NO: 139126 - RNA, 20 nt, Artificial Sequence
  mmSKRIPTE0009905_Rora_6
  gRNA
gagagacagcuuguacgccg

SEQ ID NO: 139127 - RNA, 20 nt, Artificial Sequence
  mmSKRIPTE0009906_Rora_7
  gRNA
guuaaguuaugggacgaacu

SEQ ID NO: 139128 - RNA, 20 nt, Artificial Sequence
  mmSKRIPTE0009907_Rora_8
  gRNA
agcgcugugccaucucagga

SEQ ID NO: 139129 - RNA, 20 nt, Artificial Sequence
  mmSKRIPTE0009908_Rora_9
  gRNA
uauuggcuccuaaaauaacg

SEQ ID NO: 139130 - RNA, 20 nt, Artificial Sequence
  mmSKRIPTE0009909_Ighv1-49_1
  gRNA
acgcugugaguggacuccug

SEQ ID NO: 139131 - RNA, 20 nt, Artificial Sequence
  mmSKRIPTE0009910_Ighv1-49_2
  gRNA
uagucuuucuguaaucucag

SEQ ID NO: 139132 - RNA, 20 nt, Artificial Sequence
  mmSKRIPTE0009911_Ighv1-49_3
  gRNA
cuucacccagugcauagcac

SEQ ID NO: 139133 - RNA, 20 nt, Artificial Sequence
  mmSKRIPTE0009912_Ighv1-49_4
  gRNA
agaggcacucuaggacuaug

SEQ ID NO: 139134 - RNA, 20 nt, Artificial Sequence
  mmSKRIPTE0009913_Ighv1-49_5
  gRNA
cacugggugaagcaaagacc

SEQ ID NO: 139135 - RNA, 20 nt, Artificial Sequence
  mmSKRIPTE0009914_Ighv1-49_6
  gRNA
gaccuggacauggccuggaa

SEQ ID NO: 139136 - RNA, 20 nt, Artificial Sequence
  mmSKRIPTE0009915_Ighv1-49_7
  gRNA
gagcugaguuggugagaccu

SEQ ID NO: 139137 - RNA, 20 nt, Artificial Sequence
  mmSKRIPTE0009916_Ighv1-49_8
  gRNA
gugcauagcacuggccauga

SEQ ID NO: 139138 - RNA, 20 nt, Artificial Sequence
  mmSKRIPTE0009917_Nlrc5_1
  gRNA
ggguugaggauuauccacga

SEQ ID NO: 139139 - RNA, 20 nt, Artificial Sequence
  mmSKRIPTE0009918_Nlrc5_2
  gRNA
cugcauaccucuaaguagug

SEQ ID NO: 139140 - RNA, 20 nt, Artificial Sequence
  mmSKRIPTE0009919_Nlrc5_3
  gRNA
augguaagggcucaaacggg

SEQ ID NO: 139141 - RNA, 20 nt, Artificial Sequence
  mmSKRIPTE0009920_Nlrc5_4
  gRNA
gcggagccgauaugccagag

SEQ ID NO: 139142 - RNA, 20 nt, Artificial Sequence
  mmSKRIPTE0009921_Nlrc5_5
  gRNA
ccaguuaugagacccaucag

SEQ ID NO: 139143 - RNA, 20 nt, Artificial Sequence
  mmSKRIPTE0009922_Nlrc5_6
  gRNA
aguaugauuauacccuugug

SEQ ID NO: 139144 - RNA, 20 nt, Artificial Sequence
  mmSKRIPTE0009923_Nlrc5_7
  gRNA
gcugcauucacauagccuaa

SEQ ID NO: 139145 - RNA, 20 nt, Artificial Sequence
  mmSKRIPTE0009924_Nlrc5_8
  gRNA
gagguauggugaguugcucg

SEQ ID NO: 139146 - RNA, 20 nt, Artificial Sequence
  mmSKRIPTE0009925_Nlrc5_9
  gRNA
aggucaccccagucugagag

SEQ ID NO: 139147 - RNA, 20 nt, Artificial Sequence
  mmSKRIPTE0009926_Fpr2_1
  gRNA
ggagcaauguacuacaagag

SEQ ID NO: 139148 - RNA, 20 nt, Artificial Sequence
  mmSKRIPTE0009927_Fpr2_2
  gRNA
cccuuaucacagacuucaug

SEQ ID NO: 139149 - RNA, 20 nt, Artificial Sequence
  mmSKRIPTE0009928_Fpr2_3
  gRNA
aacacaaaugcagcggucca

SEQ ID NO: 139150 - RNA, 20 nt, Artificial Sequence
  mmSKRIPTE0009929_Fpr2_4
  gRNA
uguauaccaccugcuacuac

SEQ ID NO: 139151 - RNA, 20 nt, Artificial Sequence
  mmSKRIPTE0009930_Fpr2_5
  gRNA
cuguaaggacucguaaagga

SEQ ID NO: 139152 - RNA, 20 nt, Artificial Sequence
  mmSKRIPTE0009931_Fpr2_6
  gRNA
uaaaucucucacgaaagucc

SEQ ID NO: 139153 - RNA, 20 nt, Artificial Sequence
  mmSKRIPTE0009932_Fpr2_7
  gRNA
cuuacacucuucgguuccug

SEQ ID NO: 139154 - RNA, 20 nt, Artificial Sequence
  mmSKRIPTE0009933_Fpr2_8
  gRNA
caaacagcaacaauugacau

SEQ ID NO: 139155 - RNA, 20 nt, Artificial Sequence
  mmSKRIPTE0009934_Fpr2_9
  gRNA
ucucucaagacuauaaggca

SEQ ID NO: 139156 - RNA, 20 nt, Artificial Sequence
  mmSKRIPTE0009935_Ighv1-11_1
  gRNA
uggcagcaauuacauguaag

SEQ ID NO: 139157 - RNA, 20 nt, Artificial Sequence
  mmSKRIPTE0009936_Ighv1-11_2
  gRNA
ggaccggucuacagagaaug

SEQ ID NO: 139158 - RNA, 20 nt, Artificial Sequence
  mmSKRIPTE0009937_Ighv1-11_3
  gRNA
ucuggguccucucaguuaca

SEQ ID NO: 139159 - RNA, 20 nt, Artificial Sequence
  mmSKRIPTE0009938_Ighv1-11_4
  gRNA
ugaggaugggccacacacuc

SEQ ID NO: 139160 - RNA, 20 nt, Artificial Sequence
  mmSKRIPTE0009939_Ighv1-11_5
  gRNA
aacaagguacuuguuagaua

SEQ ID NO: 139161 - RNA, 20 nt, Artificial Sequence
  mmSKRIPTE0009940_Ighv1-11_6
  gRNA
gacagugucacugaugcccc

SEQ ID NO: 139162 - RNA, 20 nt, Artificial Sequence
  mmSKRIPTE0009941_Ighv1-11_7
  gRNA
ggaaggauuuauccaguaag

SEQ ID NO: 139163 - RNA, 20 nt, Artificial Sequence
  mmSKRIPTE0009942_Ighv1-11_8
  gRNA
cugggaguaggcaccuaugg

SEQ ID NO: 139164 - RNA, 20 nt, Artificial Sequence
  mmSKRIPTE0009943_Ighv1-11_9
  gRNA
uacagaacuucauuauggga

SEQ ID NO: 139165 - RNA, 20 nt, Artificial Sequence
  mmSKRIPTE0009944_Ifne_1
  gRNA
aacuugggaaacgacguaca

SEQ ID NO: 139166 - RNA, 20 nt, Artificial Sequence
  mmSKRIPTE0009945_Ifne_2
  gRNA
caggguuucagaugcgugag

SEQ ID NO: 139167 - RNA, 20 nt, Artificial Sequence
  mmSKRIPTE0009946_Ifne_3
  gRNA
gaauacguggagucacuggg

SEQ ID NO: 139168 - RNA, 20 nt, Artificial Sequence
  mmSKRIPTE0009947_Ifne_4
  gRNA
cuuagaacacaguuaaaccu

SEQ ID NO: 139169 - RNA, 20 nt, Artificial Sequence
  mmSKRIPTE0009948_Ifne_5
  gRNA
gggaauccguuucgguucua

SEQ ID NO: 139170 - RNA, 20 nt, Artificial Sequence
  mmSKRIPTE0009949_Ifne_6
  gRNA
ucacgcuccuccagacacau

SEQ ID NO: 139171 - RNA, 20 nt, Artificial Sequence
  mmSKRIPTE0009950_Ifne_7
  gRNA
ggaaauguuccauaaaaccc

SEQ ID NO: 139172 - RNA, 20 nt, Artificial Sequence
  mmSKRIPTE0009951_Ifne_8
  gRNA
gaguccucaccaguaccaag

SEQ ID NO: 139173 - RNA, 20 nt, Artificial Sequence
  mmSKRIPTE0009952_Ifne_9
  gRNA
cacugcuggacugacgagcu

SEQ ID NO: 139174 - RNA, 20 nt, Artificial Sequence
  mmSKRIPTE0009953_Oas1d_1
  gRNA
cacuguguaaggauaucuug

SEQ ID NO: 139175 - RNA, 20 nt, Artificial Sequence
  mmSKRIPTE0009954_Oas1d_2
  gRNA
ccaguuugcuguaugcugug

SEQ ID NO: 139176 - RNA, 20 nt, Artificial Sequence
  mmSKRIPTE0009955_Oas1d_3
  gRNA
ugagacauauaagauccagu

SEQ ID NO: 139177 - RNA, 20 nt, Artificial Sequence
  mmSKRIPTE0009956_Oas1d_4
  gRNA
agcuggccuuuacagaagug

SEQ ID NO: 139178 - RNA, 20 nt, Artificial Sequence
  mmSKRIPTE0009957_Oas1d_5
  gRNA
ucuaugggcuucggcgaaca

SEQ ID NO: 139179 - RNA, 20 nt, Artificial Sequence
  mmSKRIPTE0009958_Oas1d_6
  gRNA
auugcagccugacuccuaca

SEQ ID NO: 139180 - RNA, 20 nt, Artificial Sequence
  mmSKRIPTE0009959_Oas1d_7
  gRNA
ggucauuucacaccauccag

SEQ ID NO: 139181 - RNA, 20 nt, Artificial Sequence
  mmSKRIPTE0009960_Oas1d_8
  gRNA
gugcuauucagagcuaucau

SEQ ID NO: 139182 - RNA, 20 nt, Artificial Sequence
  mmSKRIPTE0009961_Oas1d_9
  gRNA
uacgggauccacgaaaaccc

SEQ ID NO: 139183 - RNA, 20 nt, Artificial Sequence
  mmSKRIPTE0009962_Ighv12-3_1
  gRNA
auguaccccauccauucuag

SEQ ID NO: 139184 - RNA, 20 nt, Artificial Sequence
  mmSKRIPTE0009963_Ighv12-3_2
  gRNA
ucccuuuggucauuacaaug

SEQ ID NO: 139185 - RNA, 20 nt, Artificial Sequence
  mmSKRIPTE0009964_Ighv12-3_3
  gRNA
aauggcacaacucaccagga

SEQ ID NO: 139186 - RNA, 20 nt, Artificial Sequence
  mmSKRIPTE0009965_Ighv12-3_4
  gRNA
acuaaguuaaaucccauccu

SEQ ID NO: 139187 - RNA, 20 nt, Artificial Sequence
  mmSKRIPTE0009966_Ighv12-3_5
  gRNA
uuucucuaguaauggagaug

SEQ ID NO: 139188 - RNA, 20 nt, Artificial Sequence
  mmSKRIPTE0009967_Ighv12-3_6
  gRNA
gugacugugaggguuucacc

SEQ ID NO: 139189 - RNA, 20 nt, Artificial Sequence
  mmSKRIPTE0009968_Ighv12-3_7
  gRNA
ggggaaaccaguaauagagc

SEQ ID NO: 139190 - RNA, 20 nt, Artificial Sequence
  mmSKRIPTE0009969_Ighv12-3_8
  gRNA
ccagauccaguaguaaccac

SEQ ID NO: 139191 - RNA, 20 nt, Artificial Sequence
  mmSKRIPTE0009970_Ighv12-3_9
  gRNA
acacgggacacugaacucug

SEQ ID NO: 139192 - RNA, 20 nt, Artificial Sequence
  mmSKRIPTE0009971_H2-Q7_1
  gRNA
agucgaccggaaucccccag

SEQ ID NO: 139193 - RNA, 20 nt, Artificial Sequence
  mmSKRIPTE0009972_H2-Q7_2
  gRNA
gaaagaccaggccuaccugg

SEQ ID NO: 139194 - RNA, 20 nt, Artificial Sequence
  mmSKRIPTE0009973_H2-Q7_3
  gRNA
uguggggacaggauugucug

SEQ ID NO: 139195 - RNA, 20 nt, Artificial Sequence
  mmSKRIPTE0009974_H2-Q7_4
  gRNA
ugcagcgaguguuggccugg

SEQ ID NO: 139196 - RNA, 20 nt, Artificial Sequence
  mmSKRIPTE0009975_H2-Q7_5
  gRNA
ucuggggccugauuggagag

SEQ ID NO: 139197 - RNA, 20 nt, Artificial Sequence
  mmSKRIPTE0009976_H2-Q7_6
  gRNA
agaugggaauccccagccau

SEQ ID NO: 139198 - RNA, 20 nt, Artificial Sequence
  mmSKRIPTE0009977_H2-Q7_7
  gRNA
cucccccaucucaggguaag

SEQ ID NO: 139199 - RNA, 20 nt, Artificial Sequence
  mmSKRIPTE0009978_H2-Q7_8
  gRNA
gugggugugggcagacaacc

SEQ ID NO: 139200 - RNA, 20 nt, Artificial Sequence
  mmSKRIPTE0009979_H2-Q7_9
  gRNA
ggccaugagcagaguuuccg

SEQ ID NO: 139201 - RNA, 20 nt, Artificial Sequence
  mmSKRIPTE0009980_Ighv1-9_1
  gRNA
cacuggcuacuggauagagu

SEQ ID NO: 139202 - RNA, 20 nt, Artificial Sequence
  mmSKRIPTE0009981_Ighv1-9_2
  gRNA
uaauugagcaggagaacuac

SEQ ID NO: 139203 - RNA, 20 nt, Artificial Sequence
  mmSKRIPTE0009982_Ighv1-9_3
  gRNA
ggcacuauaagucugugugu

SEQ ID NO: 139204 - RNA, 20 nt, Artificial Sequence
  mmSKRIPTE0009983_Ighv1-9_4
  gRNA
uugaacauagacucuaacca

SEQ ID NO: 139205 - RNA, 20 nt, Artificial Sequence
  mmSKRIPTE0009984_Ighv1-9_5
  gRNA
uuucugauauuucagaccca

SEQ ID NO: 139206 - RNA, 20 nt, Artificial Sequence
  mmSKRIPTE0009985_Ighv1-9_6
  gRNA
ggacaguaggcacaugcguc

SEQ ID NO: 139207 - RNA, 20 nt, Artificial Sequence
  mmSKRIPTE0009986_Anxa3_1
  gRNA
uccuccuaugaaauacgcag

SEQ ID NO: 139208 - RNA, 20 nt, Artificial Sequence
  mmSKRIPTE0009987_Anxa3_2
  gRNA
ugugaacucccugaaugcga

SEQ ID NO: 139209 - RNA, 20 nt, Artificial Sequence
  mmSKRIPTE0009988_Anxa3_3
  gRNA
aagaacgggauuaaguagug

SEQ ID NO: 139210 - RNA, 20 nt, Artificial Sequence
  mmSKRIPTE0009989_Anxa3_4
  gRNA
gcuucucaaaacgcuagccg

SEQ ID NO: 139211 - RNA, 20 nt, Artificial Sequence
  mmSKRIPTE0009990_Anxa3_5
  gRNA
ccacuucgagcacgucaugg

SEQ ID NO: 139212 - RNA, 20 nt, Artificial Sequence
  mmSKRIPTE0009991_Anxa3_6
  gRNA
guaacgugcuuacaguggca

SEQ ID NO: 139213 - RNA, 20 nt, Artificial Sequence
  mmSKRIPTE0009992_Anxa3_7
  gRNA
gcuauccggaaagcgaucag

SEQ ID NO: 139214 - RNA, 20 nt, Artificial Sequence
  mmSKRIPTE0009993_Anxa3_8
  gRNA
cucacauaggaucacuuccg

SEQ ID NO: 139215 - RNA, 20 nt, Artificial Sequence
  mmSKRIPTE0009994_Anxa3_9
  gRNA
aguguauaagaagagccucg

SEQ ID NO: 139216 - RNA, 20 nt, Artificial Sequence
  mmSKRIPTE0009995_Ighv8-2_1
  gRNA
cugcacaccaguguuuacuc

SEQ ID NO: 139217 - RNA, 20 nt, Artificial Sequence
  mmSKRIPTE0009996_Ighv8-2_2
  gRNA
ucuguuccuuccuaauagag

SEQ ID NO: 139218 - RNA, 20 nt, Artificial Sequence
  mmSKRIPTE0009997_Ighv8-2_3
  gRNA
ccucagggaaggcuuuagag

SEQ ID NO: 139219 - RNA, 20 nt, Artificial Sequence
  mmSKRIPTE0009998_Ighv8-2_4
  gRNA
auuccuuaaacucaccagug

SEQ ID NO: 139220 - RNA, 20 nt, Artificial Sequence
  mmSKRIPTE0009999_Ighv8-2_5
  gRNA
ucuccaagcaccguaguaug

SEQ ID NO: 139221 - RNA, 20 nt, Artificial Sequence
  mmSKRIPTE0010000_Ighv8-2_6
  gRNA
cagaugguaagguugaaaga

SEQ ID NO: 139222 - RNA, 20 nt, Artificial Sequence
  mmSKRIPTE0010001_Ighv8-2_7
  gRNA
ugaggugcugacuugaaugg

SEQ ID NO: 139223 - RNA, 20 nt, Artificial Sequence
  mmSKRIPTE0010002_Ighv8-2_8
  gRNA
uggcacucacaugcagggac

SEQ ID NO: 139224 - RNA, 20 nt, Artificial Sequence
  mmSKRIPTE0010003_Ighv8-2_9
  gRNA
gugauggcugcaauauccca

SEQ ID NO: 139225 - RNA, 20 nt, Artificial Sequence
  mmSKRIPTE0010004_Mir125a_1
  gRNA
uuaaccugugaggacgucca

SEQ ID NO: 139226 - RNA, 20 nt, Artificial Sequence
  mmSKRIPTE0010005_Mir125a_2
  gRNA
agcuagaggaagguugccag

SEQ ID NO: 139227 - RNA, 20 nt, Artificial Sequence
  mmSKRIPTE0010006_Mir125a_3
  gRNA
uuuccccagaggugggaacg

SEQ ID NO: 139228 - RNA, 20 nt, Artificial Sequence
  mmSKRIPTE0010007_Mir125a_4
  gRNA
agaagauagugaccuuugug

SEQ ID NO: 139229 - RNA, 20 nt, Artificial Sequence
  mmSKRIPTE0010008_Mir125a_5
  gRNA
ggaaauaagacccauaacag

SEQ ID NO: 139230 - RNA, 20 nt, Artificial Sequence
  mmSKRIPTE0010009_Mir125a_6
  gRNA
guccaccauagcuacacugc

SEQ ID NO: 139231 - RNA, 20 nt, Artificial Sequence
  mmSKRIPTE0010010_Mir125a_7
  gRNA
gaaacucaaucucugaucac

SEQ ID NO: 139232 - RNA, 20 nt, Artificial Sequence
  mmSKRIPTE0010011_Mir125a_8
  gRNA
aaaucccuaaauuuguggcu

SEQ ID NO: 139233 - RNA, 20 nt, Artificial Sequence
  mmSKRIPTE0010012_Mir125a_9
  gRNA
cuaagccccagaagauagaa

SEQ ID NO: 139234 - RNA, 20 nt, Artificial Sequence
  mmSKRIPTE0010013_Ighv6-4_1
  gRNA
uauuaucccgagucugugaa

SEQ ID NO: 139235 - RNA, 20 nt, Artificial Sequence
  mmSKRIPTE0010014_Ighv6-4_2
  gRNA
accauuucuacuaucuagug

SEQ ID NO: 139236 - RNA, 20 nt, Artificial Sequence
  mmSKRIPTE0010015_Ighv6-4_3
  gRNA
cuguuuauagagauaugggg

SEQ ID NO: 139237 - RNA, 20 nt, Artificial Sequence
  mmSKRIPTE0010016_Ighv6-4_4
  gRNA
ggaguucugagguccauuag

SEQ ID NO: 139238 - RNA, 20 nt, Artificial Sequence
  mmSKRIPTE0010017_Ighv6-4_5
  gRNA
aucuacaaaaguaaauccag

SEQ ID NO: 139239 - RNA, 20 nt, Artificial Sequence
  mmSKRIPTE0010018_Ighv6-4_6
  gRNA
uggccauguaaccuagagac

SEQ ID NO: 139240 - RNA, 20 nt, Artificial Sequence
  mmSKRIPTE0010019_Ighv6-4_7
  gRNA
ggaggcuuaguuaaaccugg

SEQ ID NO: 139241 - RNA, 20 nt, Artificial Sequence
  mmSKRIPTE0010020_Ighv6-4_8
  gRNA
gguggauagauucacaauga

SEQ ID NO: 139242 - RNA, 20 nt, Artificial Sequence
  mmSKRIPTE0010021_Ighv6-4_9
  gRNA
cuacuguuuauagagauaug

SEQ ID NO: 139243 - RNA, 20 nt, Artificial Sequence
  mmSKRIPTE0010022_Mir223_1
  gRNA
uuugucaaauaccccaagug

SEQ ID NO: 139244 - RNA, 20 nt, Artificial Sequence
  mmSKRIPTE0010023_Mir223_2
  gRNA
gcugaguuggacacucugug

SEQ ID NO: 139245 - RNA, 20 nt, Artificial Sequence
  mmSKRIPTE0010024_Mir223_3
  gRNA
ccagaucaggaaccuccacu

SEQ ID NO: 139246 - RNA, 20 nt, Artificial Sequence
  mmSKRIPTE0010025_Mir223_4
  gRNA
guaggaacgaugcagcucug

SEQ ID NO: 139247 - RNA, 20 nt, Artificial Sequence
  mmSKRIPTE0010026_Mir223_5
  gRNA
uacccuaagugugagacaaa

SEQ ID NO: 139248 - RNA, 20 nt, Artificial Sequence
  mmSKRIPTE0010027_Mir223_6
  gRNA
uguacauugugaaaaugcca

SEQ ID NO: 139249 - RNA, 20 nt, Artificial Sequence
  mmSKRIPTE0010028_Mir223_7
  gRNA
agcauucauauguaggcagc

SEQ ID NO: 139250 - RNA, 20 nt, Artificial Sequence
  mmSKRIPTE0010029_Mir223_8
  gRNA
caaacaaaaacggggauccu

SEQ ID NO: 139251 - RNA, 20 nt, Artificial Sequence
  mmSKRIPTE0010030_Mir223_9
  gRNA
gauaggcaugagccacacuu

SEQ ID NO: 139252 - RNA, 20 nt, Artificial Sequence
  mmSKRIPTE0010031_Ighv6-3_1
  gRNA
gcuauaucaugagcucaggg

SEQ ID NO: 139253 - RNA, 20 nt, Artificial Sequence
  mmSKRIPTE0010032_Ighv6-3_2
  gRNA
cugacagaggcaccuaacug

SEQ ID NO: 139254 - RNA, 20 nt, Artificial Sequence
  mmSKRIPTE0010033_Ighv6-3_3
  gRNA
auuaugcggagucugugaaa

SEQ ID NO: 139255 - RNA, 20 nt, Artificial Sequence
  mmSKRIPTE0010034_Ighv6-3_4
  gRNA
uuucccuucagugaccaaca

SEQ ID NO: 139256 - RNA, 20 nt, Artificial Sequence
  mmSKRIPTE0010035_Ighv6-3_5
  gRNA
cuagacacaaacuuacccaa

SEQ ID NO: 139257 - RNA, 20 nt, Artificial Sequence
  mmSKRIPTE0010036_Ighv6-3_6
  gRNA
uaaaugggcuauuguuuaca

SEQ ID NO: 139258 - RNA, 20 nt, Artificial Sequence
  mmSKRIPTE0010037_Ighv6-3_7
  gRNA
ccacuccagaugguggagga

SEQ ID NO: 139259 - RNA, 20 nt, Artificial Sequence
  mmSKRIPTE0010038_Ighv6-3_8
  gRNA
ugaauguucuguguccgugu

SEQ ID NO: 139260 - RNA, 20 nt, Artificial Sequence
  mmSKRIPTE0010039_Ighv6-3_9
  gRNA
uauugagugugugaguggac

SEQ ID NO: 139261 - RNA, 20 nt, Artificial Sequence
  mmSKRIPTE0010040_Ighv2-3_1
  gRNA
ggguuuggcacaguaguacg

SEQ ID NO: 139262 - RNA, 20 nt, Artificial Sequence
  mmSKRIPTE0010041_Ighv2-3_2
  gRNA
aaccagcuaugguguaagcu

SEQ ID NO: 139263 - RNA, 20 nt, Artificial Sequence
  mmSKRIPTE0010042_Ighv2-3_3
  gRNA
guauuugugaaugcucacaa

SEQ ID NO: 139264 - RNA, 20 nt, Artificial Sequence
  mmSKRIPTE0010043_Ighv2-3_4
  gRNA
aaaauaucucuguugcggua

SEQ ID NO: 139265 - RNA, 20 nt, Artificial Sequence
  mmSKRIPTE0010044_Ighv2-3_5
  gRNA
aggacacaaaggaacuugcc

SEQ ID NO: 139266 - RNA, 20 nt, Artificial Sequence
  mmSKRIPTE0010045_Ighv2-3_6
  gRNA
ugggaguaauauggggugac

SEQ ID NO: 139267 - RNA, 20 nt, Artificial Sequence
  mmSKRIPTE0010046_Ighv2-9-1_1
  gRNA
acaaccagcagggggcuccg

SEQ ID NO: 139268 - RNA, 20 nt, Artificial Sequence
  mmSKRIPTE0010047_Ighv2-9-1_2
  gRNA
uggcuuggaguaauauggac

SEQ ID NO: 139269 - RNA, 20 nt, Artificial Sequence
  mmSKRIPTE0010048_Ighv2-9-1_3
  gRNA
aaccagcuaugcuauaagcu

SEQ ID NO: 139270 - RNA, 20 nt, Artificial Sequence
  mmSKRIPTE0010049_Ighv2-9-1_4
  gRNA
uagguuccagaagacauccu

SEQ ID NO: 139271 - RNA, 20 nt, Artificial Sequence
  mmSKRIPTE0010050_Ighv2-9-1_5
  gRNA
uggugauguugcucaucccc

SEQ ID NO: 139272 - RNA, 20 nt, Artificial Sequence
  mmSKRIPTE0010051_Ighv2-9-1_6
  gRNA
guuucuggcacaguaguacc

SEQ ID NO: 139273 - RNA, 20 nt, Artificial Sequence
  mmSKRIPTE0010052_Ighv1-85_1
  gRNA
gguuacugagcaacucuaag

SEQ ID NO: 139274 - RNA, 20 nt, Artificial Sequence
  mmSKRIPTE0010053_Ighv1-85_2
  gRNA
cacaagcuacgauauaaacu

SEQ ID NO: 139275 - RNA, 20 nt, Artificial Sequence
  mmSKRIPTE0010054_Ighv1-85_3
  gRNA
guggagaggacauuggccau

SEQ ID NO: 139276 - RNA, 20 nt, Artificial Sequence
  mmSKRIPTE0010055_Ighv1-85_4
  gRNA
uguuaggcagcaguaugcuc

SEQ ID NO: 139277 - RNA, 20 nt, Artificial Sequence
  mmSKRIPTE0010056_Ighv1-85_5
  gRNA
ggcacuguaggaaugugagg

SEQ ID NO: 139278 - RNA, 20 nt, Artificial Sequence
  mmSKRIPTE0010057_Ighv1-85_6
  gRNA
ggauggauuuauccuagaga

SEQ ID NO: 139279 - RNA, 20 nt, Artificial Sequence
  mmSKRIPTE0010058_Ighv1-85_7
  gRNA
gaacugccauuucauguguu

SEQ ID NO: 139280 - RNA, 20 nt, Artificial Sequence
  mmSKRIPTE0010059_Ighv1-85_8
  gRNA
gcacagcuuccugcuccccc

SEQ ID NO: 139281 - RNA, 20 nt, Artificial Sequence
  mmSKRIPTE0010060_H2-M9_1
  gRNA
ucgaggccaugauaagaagg

SEQ ID NO: 139282 - RNA, 20 nt, Artificial Sequence
  mmSKRIPTE0010061_H2-M9_2
  gRNA
gcuggcgauucaggacccua

SEQ ID NO: 139283 - RNA, 20 nt, Artificial Sequence
  mmSKRIPTE0010062_H2-M9_3
  gRNA
agccuggauguagcacauag

SEQ ID NO: 139284 - RNA, 20 nt, Artificial Sequence
  mmSKRIPTE0010063_H2-M9_4
  gRNA
ucccaguuacugcaccccca

SEQ ID NO: 139285 - RNA, 20 nt, Artificial Sequence
  mmSKRIPTE0010064_H2-M9_5
  gRNA
ggaugcggcaaucuauuccu

SEQ ID NO: 139286 - RNA, 20 nt, Artificial Sequence
  mmSKRIPTE0010065_H2-M9_6
  gRNA
uccauuaggaaaagucacau

SEQ ID NO: 139287 - RNA, 20 nt, Artificial Sequence
  mmSKRIPTE0010066_H2-M9_7
  gRNA
ggguucaggaggaucuuggg

SEQ ID NO: 139288 - RNA, 20 nt, Artificial Sequence
  mmSKRIPTE0010067_H2-M9_8
  gRNA
uggaugcuuugcgaugacca

SEQ ID NO: 139289 - RNA, 20 nt, Artificial Sequence
  mmSKRIPTE0010068_H2-M9_9
  gRNA
aguaacaugcccuguacaag

SEQ ID NO: 139290 - RNA, 20 nt, Artificial Sequence
  mmSKRIPTE0010069_Ighv2-5_1
  gRNA
cuagauucugaagugaaccu

SEQ ID NO: 139291 - RNA, 20 nt, Artificial Sequence
  mmSKRIPTE0010070_Ighv2-5_2
  gRNA
gggacuaagacuugucagcc

SEQ ID NO: 139292 - RNA, 20 nt, Artificial Sequence
  mmSKRIPTE0010071_Ighv2-5_3
  gRNA
agacugugcagguuauggac

SEQ ID NO: 139293 - RNA, 20 nt, Artificial Sequence
  mmSKRIPTE0010072_Ighv2-5_4
  gRNA
acugugcuuguugaagcacc

SEQ ID NO: 139294 - RNA, 20 nt, Artificial Sequence
  mmSKRIPTE0010073_Ighv2-5_5
  gRNA
auuucacuagaaggaugauc

SEQ ID NO: 139295 - RNA, 20 nt, Artificial Sequence
  mmSKRIPTE0010074_Ighv2-7_1
  gRNA
cauuccaaucccuuucucgg

SEQ ID NO: 139296 - RNA, 20 nt, Artificial Sequence
  mmSKRIPTE0010075_Ighv2-7_2
  gRNA
auaccaugaaugccauaccu

SEQ ID NO: 139297 - RNA, 20 nt, Artificial Sequence
  mmSKRIPTE0010076_Ighv2-7_3
  gRNA
gcuggucaugacaucccugu

SEQ ID NO: 139298 - RNA, 20 nt, Artificial Sequence
  mmSKRIPTE0010077_Ighv2-7_4
  gRNA
uucccgacugagugucagca

SEQ ID NO: 139299 - RNA, 20 nt, Artificial Sequence
  mmSKRIPTE0010078_Ighv2-7_5
  gRNA
uuucgcaagccuccgagaaa

SEQ ID NO: 139300 - RNA, 20 nt, Artificial Sequence
  mmSKRIPTE0010079_Ighv2-7_6
  gRNA
gcacuugugacaggacaccu

SEQ ID NO: 139301 - RNA, 20 nt, Artificial Sequence
  mmSKRIPTE0010080_Ighv2-7_7
  gRNA
aaccgaugcucauacagcau

SEQ ID NO: 139302 - RNA, 20 nt, Artificial Sequence
  mmSKRIPTE0010081_Ighv2-7_8
  gRNA
cuccgagaaagggauuggaa

SEQ ID NO: 139303 - RNA, 20 nt, Artificial Sequence
  mmSKRIPTE0010082_Ighv2-7_9
  gRNA
gagucugugauggcugcaca

SEQ ID NO: 139304 - RNA, 20 nt, Artificial Sequence
  mmSKRIPTE0010083_Ighv7-2_1
  gRNA
cuggccaaacaacauaggua

SEQ ID NO: 139305 - RNA, 20 nt, Artificial Sequence
  mmSKRIPTE0010084_Ighv7-2_2
  gRNA
gagacaaguagcugugcaug

SEQ ID NO: 139306 - RNA, 20 nt, Artificial Sequence
  mmSKRIPTE0010085_Ighv7-2_3
  gRNA
gacuacagugcaucuaugaa

SEQ ID NO: 139307 - RNA, 20 nt, Artificial Sequence
  mmSKRIPTE0010086_Ighv7-2_4
  gRNA
cuccaaagaaguguuugcgu

SEQ ID NO: 139308 - RNA, 20 nt, Artificial Sequence
  mmSKRIPTE0010087_Ighv7-2_5
  gRNA
uugaaacaaaccucauugca

SEQ ID NO: 139309 - RNA, 20 nt, Artificial Sequence
  mmSKRIPTE0010088_Ighv7-2_6
  gRNA
caauauuagagaacuggugc

SEQ ID NO: 139310 - RNA, 20 nt, Artificial Sequence
  mmSKRIPTE0010089_Ighv7-2_7
  gRNA
augagauucccaugacuggc

SEQ ID NO: 139311 - RNA, 20 nt, Artificial Sequence
  mmSKRIPTE0010090_Ighv7-2_8
  gRNA
guucauguagaaaucaguga

SEQ ID NO: 139312 - RNA, 20 nt, Artificial Sequence
  mmSKRIPTE0010091_Ighv7-2_9
  gRNA
ugguaauuuguggugaaaau

SEQ ID NO: 139313 - RNA, 20 nt, Artificial Sequence
  mmSKRIPTE0010092_Ighv6-5_1
  gRNA
cuguuuauagagaucuggug

SEQ ID NO: 139314 - RNA, 20 nt, Artificial Sequence
  mmSKRIPTE0010093_Ighv6-5_2
  gRNA
guguguacuccaugaaccug

SEQ ID NO: 139315 - RNA, 20 nt, Artificial Sequence
  mmSKRIPTE0010094_Ighv6-5_3
  gRNA
ccaacccauucucuguagag

SEQ ID NO: 139316 - RNA, 20 nt, Artificial Sequence
  mmSKRIPTE0010095_Ighv6-5_4
  gRNA
cacaguagccaugcaaacca

SEQ ID NO: 139317 - RNA, 20 nt, Artificial Sequence
  mmSKRIPTE0010096_Ighv6-5_5
  gRNA
ccagagugaagugaaaauug

SEQ ID NO: 139318 - RNA, 20 nt, Artificial Sequence
  mmSKRIPTE0010097_Ighv6-5_6
  gRNA
accuuguuguagguguucug

SEQ ID NO: 139319 - RNA, 20 nt, Artificial Sequence
  mmSKRIPTE0010098_Ighv6-5_7
  gRNA
guuucauggauccuccaggu

SEQ ID NO: 139320 - RNA, 20 nt, Artificial Sequence
  mmSKRIPTE0010099_Ighv6-5_8
  gRNA
acaguucaguuccaagucca

SEQ ID NO: 139321 - RNA, 20 nt, Artificial Sequence
  mmSKRIPTE0010100_Ighv6-5_9
  gRNA
gaaaugguaucaauagauag

SEQ ID NO: 139322 - RNA, 20 nt, Artificial Sequence
  mmSKRIPTE0010101_Ifna4_1
  gRNA
aguaguagcucaucauuacc

SEQ ID NO: 139323 - RNA, 20 nt, Artificial Sequence
  mmSKRIPTE0010102_Ifna4_2
  gRNA
ggguaagaucucuuagcaca

SEQ ID NO: 139324 - RNA, 20 nt, Artificial Sequence
  mmSKRIPTE0010103_Ifna4_3
  gRNA
aggagguuccugcaucacac

SEQ ID NO: 139325 - RNA, 20 nt, Artificial Sequence
  mmSKRIPTE0010104_Ifna4_4
  gRNA
agcaucuacaagacccacaa

SEQ ID NO: 139326 - RNA, 20 nt, Artificial Sequence
  mmSKRIPTE0010105_Ifna4_5
  gRNA
uuaagagagauguacacagc

SEQ ID NO: 139327 - RNA, 20 nt, Artificial Sequence
  mmSKRIPTE0010106_Ifna4_6
  gRNA
caagagggccuugacagucc

SEQ ID NO: 139328 - RNA, 20 nt, Artificial Sequence
  mmSKRIPTE0010107_Ifna4_7
  gRNA
gauugcugaaacaucuaugc

SEQ ID NO: 139329 - RNA, 20 nt, Artificial Sequence
  mmSKRIPTE0010108_Ifna4_8
  gRNA
ucuugccagcaaguugguug

SEQ ID NO: 139330 - RNA, 20 nt, Artificial Sequence
  mmSKRIPTE0010109_Skint2_1
  gRNA
aagccaguagaauaguaugg

SEQ ID NO: 139331 - RNA, 20 nt, Artificial Sequence
  mmSKRIPTE0010110_Skint2_2
  gRNA
ugcuccccauauagggccaa

SEQ ID NO: 139332 - RNA, 20 nt, Artificial Sequence
  mmSKRIPTE0010111_Skint2_3
  gRNA
auggcaccacauacucccaa

SEQ ID NO: 139333 - RNA, 20 nt, Artificial Sequence
  mmSKRIPTE0010112_Skint2_4
  gRNA
ucaaaaagucuacaggaccc

SEQ ID NO: 139334 - RNA, 20 nt, Artificial Sequence
  mmSKRIPTE0010113_Skint2_5
  gRNA
aauguacaugacugagcuug

SEQ ID NO: 139335 - RNA, 20 nt, Artificial Sequence
  mmSKRIPTE0010114_Skint2_6
  gRNA
ucacagugacuggcuuacag

SEQ ID NO: 139336 - RNA, 20 nt, Artificial Sequence
  mmSKRIPTE0010115_Skint2_7
  gRNA
gauagcaagugauacuccug

SEQ ID NO: 139337 - RNA, 20 nt, Artificial Sequence
  mmSKRIPTE0010116_Skint2_8
  gRNA
uaucauuccagcuacaucaa

SEQ ID NO: 139338 - RNA, 20 nt, Artificial Sequence
  mmSKRIPTE0010117_Skint2_9
  gRNA
agguauacaauauuccuccc

SEQ ID NO: 139339 - RNA, 20 nt, Artificial Sequence
  mmSKRIPTE0010118_Ighv14-3_1
  gRNA
guuaggacuuggacugacuc

SEQ ID NO: 139340 - RNA, 20 nt, Artificial Sequence
  mmSKRIPTE0010119_Ighv14-3_2
  gRNA
gccacugucacagagugugu

SEQ ID NO: 139341 - RNA, 20 nt, Artificial Sequence
  mmSKRIPTE0010120_Ighv14-3_3
  gRNA
agguggaggaagcagacgua

SEQ ID NO: 139342 - RNA, 20 nt, Artificial Sequence
  mmSKRIPTE0010121_Ighv14-3_4
  gRNA
uauuuaguauuaccauucgc

SEQ ID NO: 139343 - RNA, 20 nt, Artificial Sequence
  mmSKRIPTE0010122_Ighv14-3_5
  gRNA
uaaaaacaccuauaugcacu

SEQ ID NO: 139344 - RNA, 20 nt, Artificial Sequence
  mmSKRIPTE0010123_Ighv14-3_6
  gRNA
uauagggcucauaugauguu

SEQ ID NO: 139345 - RNA, 20 nt, Artificial Sequence
  mmSKRIPTE0010124_Ighv14-3_7
  gRNA
gucagaaaccauagaacugc

SEQ ID NO: 139346 - RNA, 20 nt, Artificial Sequence
  mmSKRIPTE0010125_Ighv14-3_8
  gRNA
uggacccaggaguuaggacu

SEQ ID NO: 139347 - RNA, 20 nt, Artificial Sequence
  mmSKRIPTE0010126_Ighv14-3_9
  gRNA
uuacauaaggacauuccagc

SEQ ID NO: 139348 - RNA, 20 nt, Artificial Sequence
  mmSKRIPTE0010127_Cebpd_1
  gRNA
gagcagcugugucgucaccc

SEQ ID NO: 139349 - RNA, 20 nt, Artificial Sequence
  mmSKRIPTE0010128_Cebpd_2
  gRNA
gagacccugaagaacugcag

SEQ ID NO: 139350 - RNA, 20 nt, Artificial Sequence
  mmSKRIPTE0010129_Cebpd_3
  gRNA
auguuaucaaacuuguagga

SEQ ID NO: 139351 - RNA, 20 nt, Artificial Sequence
  mmSKRIPTE0010130_Cebpd_4
  gRNA
caagcgcacagaugucaggg

SEQ ID NO: 139352 - RNA, 20 nt, Artificial Sequence
  mmSKRIPTE0010131_Cebpd_5
  gRNA
gauugagcugcugaguacag

SEQ ID NO: 139353 - RNA, 20 nt, Artificial Sequence
  mmSKRIPTE0010132_Cebpd_6
  gRNA
ccucacacccaacauuguau

SEQ ID NO: 139354 - RNA, 20 nt, Artificial Sequence
  mmSKRIPTE0010133_Cebpd_7
  gRNA
aaaccacaaaguguuuaggu

SEQ ID NO: 139355 - RNA, 20 nt, Artificial Sequence
  mmSKRIPTE0010134_Cebpd_8
  gRNA
acaagccugcacuuugggca

SEQ ID NO: 139356 - RNA, 20 nt, Artificial Sequence
  mmSKRIPTE0010135_Cebpd_9
  gRNA
cuucagggucucugacaggu

SEQ ID NO: 139357 - RNA, 20 nt, Artificial Sequence
  mmSKRIPTE0010136_Ighv5-12-4_1
  gRNA
aucaugaguggcaucagacu

SEQ ID NO: 139358 - RNA, 20 nt, Artificial Sequence
  mmSKRIPTE0010137_Ighv5-12-4_2
  gRNA
uuggcacccaggaugagcag

SEQ ID NO: 139359 - RNA, 20 nt, Artificial Sequence
  mmSKRIPTE0010138_Ighv5-12-4_3
  gRNA
gcugagcccgaaguucauag

SEQ ID NO: 139360 - RNA, 20 nt, Artificial Sequence
  mmSKRIPTE0010139_Ighv5-12-4_4
  gRNA
aaugaccagucugaagucag

SEQ ID NO: 139361 - RNA, 20 nt, Artificial Sequence
  mmSKRIPTE0010140_Ighv5-12-4_5
  gRNA
cugggaaucgaauccaugau

SEQ ID NO: 139362 - RNA, 20 nt, Artificial Sequence
  mmSKRIPTE0010141_Ighv5-12-4_6
  gRNA
aagguuggguacaauuguac

SEQ ID NO: 139363 - RNA, 20 nt, Artificial Sequence
  mmSKRIPTE0010142_Ighv5-12-4_7
  gRNA
gagaguuucagggacugucc

SEQ ID NO: 139364 - RNA, 20 nt, Artificial Sequence
  mmSKRIPTE0010143_Ifnb1_1
  gRNA
ccugugcuauuuauaaggga

SEQ ID NO: 139365 - RNA, 20 nt, Artificial Sequence
  mmSKRIPTE0010144_Ifnb1_2
  gRNA
cggcugcuaccugcaagaug

SEQ ID NO: 139366 - RNA, 20 nt, Artificial Sequence
  mmSKRIPTE0010145_Ifnb1_3
  gRNA
guacaacagcuacgccugga

SEQ ID NO: 139367 - RNA, 20 nt, Artificial Sequence
  mmSKRIPTE0010146_Ifnb1_4
  gRNA
gacgaacauucggaaauguc

SEQ ID NO: 139368 - RNA, 20 nt, Artificial Sequence
  mmSKRIPTE0010147_Ifnb1_5
  gRNA
ugaaguccgcccuguaggug

SEQ ID NO: 139369 - RNA, 20 nt, Artificial Sequence
  mmSKRIPTE0010148_Ifnb1_6
  gRNA
uccaguaauagcucuucaag

SEQ ID NO: 139370 - RNA, 20 nt, Artificial Sequence
  mmSKRIPTE0010149_Ifnb1_7
  gRNA
caaccuuuaagcaucagagg

SEQ ID NO: 139371 - RNA, 20 nt, Artificial Sequence
  mmSKRIPTE0010150_Ifnb1_8
  gRNA
guuucugaagacaguacuag

SEQ ID NO: 139372 - RNA, 20 nt, Artificial Sequence
  mmSKRIPTE0010151_Ifnb1_9
  gRNA
gcugcuuauaguugauggag

SEQ ID NO: 139373 - RNA, 20 nt, Artificial Sequence
  mmSKRIPTE0010152_Gm7030_1
  gRNA
ugcauauccuggauagugug

SEQ ID NO: 139374 - RNA, 20 nt, Artificial Sequence
  mmSKRIPTE0010153_Gm7030_2
  gRNA
agagugugggugcauaacug

SEQ ID NO: 139375 - RNA, 20 nt, Artificial Sequence
  mmSKRIPTE0010154_Gm7030_3
  gRNA
uccauccucagacucuaaca

SEQ ID NO: 139376 - RNA, 20 nt, Artificial Sequence
  mmSKRIPTE0010155_Gm7030_4
  gRNA
ucuugacccaguauccagag

SEQ ID NO: 139377 - RNA, 20 nt, Artificial Sequence
  mmSKRIPTE0010156_Gm7030_5
  gRNA
acucuguccugaccagcuca

SEQ ID NO: 139378 - RNA, 20 nt, Artificial Sequence
  mmSKRIPTE0010157_Gm7030_6
  gRNA
augagaguccuggagaaccu

SEQ ID NO: 139379 - RNA, 20 nt, Artificial Sequence
  mmSKRIPTE0010158_Gm7030_7
  gRNA
gaucaaucccauggaggcau

SEQ ID NO: 139380 - RNA, 20 nt, Artificial Sequence
  mmSKRIPTE0010159_Gm7030_8
  gRNA
aaccuccucucaaugggccu

SEQ ID NO: 139381 - RNA, 20 nt, Artificial Sequence
  mmSKRIPTE0010160_Gm7030_9
  gRNA
aaccggggcuccccuaagcc

SEQ ID NO: 139382 - RNA, 20 nt, Artificial Sequence
  mmSKRIPTE0010161_Ighv1-7_1
  gRNA
accugcuauuacugacaaca

SEQ ID NO: 139383 - RNA, 20 nt, Artificial Sequence
  mmSKRIPTE0010162_Ighv1-7_2
  gRNA
uucagaaaagacuaaccugu

SEQ ID NO: 139384 - RNA, 20 nt, Artificial Sequence
  mmSKRIPTE0010163_Ighv1-7_3
  gRNA
gugcauccaguagcuaguaa

SEQ ID NO: 139385 - RNA, 20 nt, Artificial Sequence
  mmSKRIPTE0010164_Ighv1-7_4
  gRNA
ggcugaacuggcaaaaccug

SEQ ID NO: 139386 - RNA, 20 nt, Artificial Sequence
  mmSKRIPTE0010165_Ighv1-7_5
  gRNA
guacuuggaccucagcaccc

SEQ ID NO: 139387 - RNA, 20 nt, Artificial Sequence
  mmSKRIPTE0010166_Ighv1-7_6
  gRNA
agcaagguaccucuuagaua

SEQ ID NO: 139388 - RNA, 20 nt, Artificial Sequence
  mmSKRIPTE0010167_Ifna11_1
  gRNA
ucaucacuaucaagaucaug

SEQ ID NO: 139389 - RNA, 20 nt, Artificial Sequence
  mmSKRIPTE0010168_Ifna11_2
  gRNA
caaggggaggguauuuacaa

SEQ ID NO: 139390 - RNA, 20 nt, Artificial Sequence
  mmSKRIPTE0010169_Ifna11_3
  gRNA
uugaguccugagaccaagug

SEQ ID NO: 139391 - RNA, 20 nt, Artificial Sequence
  mmSKRIPTE0010170_Ifna11_4
  gRNA
agguccuggcacaaaugagg

SEQ ID NO: 139392 - RNA, 20 nt, Artificial Sequence
  mmSKRIPTE0010171_Ifna11_5
  gRNA
cugcaagacccauaauggcu

SEQ ID NO: 139393 - RNA, 20 nt, Artificial Sequence
  mmSKRIPTE0010172_Ifna11_6
  gRNA
uaacaaauaggugcggauac

SEQ ID NO: 139394 - RNA, 20 nt, Artificial Sequence
  mmSKRIPTE0010173_Ifna11_7
  gRNA
cuugaaccucuucgcaucaa

SEQ ID NO: 139395 - RNA, 20 nt, Artificial Sequence
  mmSKRIPTE0010174_Ifna11_8
  gRNA
caccccucuuuccugccuaa

SEQ ID NO: 139396 - RNA, 20 nt, Artificial Sequence
  mmSKRIPTE0010175_Ifna11_9
  gRNA
aguaggcuugucagagaacc

SEQ ID NO: 139397 - RNA, 20 nt, Artificial Sequence
  mmSKRIPTE0010176_Ighv3-8_1
  gRNA
auggaaacacucacccggaa

SEQ ID NO: 139398 - RNA, 20 nt, Artificial Sequence
  mmSKRIPTE0010177_Ighv3-8_2
  gRNA
acuggauccggaaauuccca

SEQ ID NO: 139399 - RNA, 20 nt, Artificial Sequence
  mmSKRIPTE0010178_Ighv3-8_3
  gRNA
gauaggaacugccauagaca

SEQ ID NO: 139400 - RNA, 20 nt, Artificial Sequence
  mmSKRIPTE0010179_Ighv3-8_4
  gRNA
cuuuaccuucauaauuggag

SEQ ID NO: 139401 - RNA, 20 nt, Artificial Sequence
  mmSKRIPTE0010180_Ighv3-8_5
  gRNA
gucugaagguauccugucag

SEQ ID NO: 139402 - RNA, 20 nt, Artificial Sequence
  mmSKRIPTE0010181_Ighv3-8_6
  gRNA
aaagaguauuagugggcucu

SEQ ID NO: 139403 - RNA, 20 nt, Artificial Sequence
  mmSKRIPTE0010182_Ighv3-8_7
  gRNA
ggaauaaacuugaguacaug

SEQ ID NO: 139404 - RNA, 20 nt, Artificial Sequence
  mmSKRIPTE0010183_Ighv3-8_8
  gRNA
agugugucuuccuguacagc

SEQ ID NO: 139405 - RNA, 20 nt, Artificial Sequence
  mmSKRIPTE0010184_Ighv3-8_9
  gRNA
ucaauuauugcccaaaauug

SEQ ID NO: 139406 - RNA, 20 nt, Artificial Sequence
  mmSKRIPTE0010185_Iglc3_1
  gRNA
ggaaaucagacacacgagug

SEQ ID NO: 139407 - RNA, 20 nt, Artificial Sequence
  mmSKRIPTE0010186_Iglc3_2
  gRNA
accuuugaaucuacaaugug

SEQ ID NO: 139408 - RNA, 20 nt, Artificial Sequence
  mmSKRIPTE0010187_Iglc3_3
  gRNA
uuuacaucugaaacauacug

SEQ ID NO: 139409 - RNA, 20 nt, Artificial Sequence
  mmSKRIPTE0010188_Iglc3_4
  gRNA
ccuaggaacccugcagcugu

SEQ ID NO: 139410 - RNA, 20 nt, Artificial Sequence
  mmSKRIPTE0010189_Iglc3_5
  gRNA
uagagaagagaccccacucu

SEQ ID NO: 139411 - RNA, 20 nt, Artificial Sequence
  mmSKRIPTE0010190_Iglc3_6
  gRNA
ggccacugucacaccacuug

SEQ ID NO: 139412 - RNA, 20 nt, Artificial Sequence
  mmSKRIPTE0010191_Iglc3_7
  gRNA
cccuucauguguaacuuggc

SEQ ID NO: 139413 - RNA, 20 nt, Artificial Sequence
  mmSKRIPTE0010192_Iglc3_8
  gRNA
cagggcaaaggucacuguug

SEQ ID NO: 139414 - RNA, 20 nt, Artificial Sequence
  mmSKRIPTE0010193_Iglc3_9
  gRNA
gguggaaacauggugagugu

SEQ ID NO: 139415 - RNA, 20 nt, Artificial Sequence
  mmSKRIPTE0010194_Cd24a_1
  gRNA
gacuggagaguguaauucag

SEQ ID NO: 139416 - RNA, 20 nt, Artificial Sequence
  mmSKRIPTE0010195_Cd24a_2
  gRNA
auaugguaacagccaauucg

SEQ ID NO: 139417 - RNA, 20 nt, Artificial Sequence
  mmSKRIPTE0010196_Cd24a_3
  gRNA
auaauagucucuguagcugc

SEQ ID NO: 139418 - RNA, 20 nt, Artificial Sequence
  mmSKRIPTE0010197_Cd24a_4
  gRNA
auauucugguuaccgggaaa

SEQ ID NO: 139419 - RNA, 20 nt, Artificial Sequence
  mmSKRIPTE0010198_Cd24a_5
  gRNA
agugcaaauggagauagcug

SEQ ID NO: 139420 - RNA, 20 nt, Artificial Sequence
  mmSKRIPTE0010199_Cd24a_6
  gRNA
aauuuaauaccguaagcucu

SEQ ID NO: 139421 - RNA, 20 nt, Artificial Sequence
  mmSKRIPTE0010200_Cd24a_7
  gRNA
cccgguauauaaggucccgc

SEQ ID NO: 139422 - RNA, 20 nt, Artificial Sequence
  mmSKRIPTE0010201_Cd24a_8
  gRNA
ugcagguagaagccaaacac

SEQ ID NO: 139423 - RNA, 20 nt, Artificial Sequence
  mmSKRIPTE0010202_Cd24a_9
  gRNA
ccagugcccaaucgagaaca

SEQ ID NO: 139424 - RNA, 20 nt, Artificial Sequence
  mmSKRIPTE0010203_Ighv5-2_1
  gRNA
gcggacccaagacaugucau

SEQ ID NO: 139425 - RNA, 20 nt, Artificial Sequence
  mmSKRIPTE0010204_Ighv5-2_2
  gRNA
gaugaugaaucgucucucca

SEQ ID NO: 139426 - RNA, 20 nt, Artificial Sequence
  mmSKRIPTE0010205_Ighv5-2_3
  gRNA
uuauaucuaugaugaucacu

SEQ ID NO: 139427 - RNA, 20 nt, Artificial Sequence
  mmSKRIPTE0010206_Ighv5-2_4
  gRNA
gucgcagccauuaauaguga

SEQ ID NO: 139428 - RNA, 20 nt, Artificial Sequence
  mmSKRIPTE0010207_Ighv5-2_5
  gRNA
caccugcaaacaaagagugc

SEQ ID NO: 139429 - RNA, 20 nt, Artificial Sequence
  mmSKRIPTE0010208_Ighv5-2_6
  gRNA
cugacagagaagcucagccc

SEQ ID NO: 139430 - RNA, 20 nt, Artificial Sequence
  mmSKRIPTE0010209_Ighv5-2_7
  gRNA
gguccugcuauagcaugcuc

SEQ ID NO: 139431 - RNA, 20 nt, Artificial Sequence
  mmSKRIPTE0010210_H2-Q8_1
  gRNA
caccgggaaccaaucagcgu

SEQ ID NO: 139432 - RNA, 20 nt, Artificial Sequence
  mmSKRIPTE0010211_H2-Q8_2
  gRNA
agucgaccugaauccccgag

SEQ ID NO: 139433 - RNA, 20 nt, Artificial Sequence
  mmSKRIPTE0010212_H2-Q8_3
  gRNA
uaaugaaccggggcuccacg

SEQ ID NO: 139434 - RNA, 20 nt, Artificial Sequence
  mmSKRIPTE0010213_H2-Q8_4
  gRNA
caggggcaucacccagcuga

SEQ ID NO: 139435 - RNA, 20 nt, Artificial Sequence
  mmSKRIPTE0010214_H2-Q8_5
  gRNA
acagaucacccuacacaagu

SEQ ID NO: 139436 - RNA, 20 nt, Artificial Sequence
  mmSKRIPTE0010215_H2-Q8_6
  gRNA
agagaccgggccuaccugga

SEQ ID NO: 139437 - RNA, 20 nt, Artificial Sequence
  mmSKRIPTE0010216_H2-Q8_7
  gRNA
ucacucggaaacucuccuca

SEQ ID NO: 139438 - RNA, 20 nt, Artificial Sequence
  mmSKRIPTE0010217_Ddx17_1
  gRNA
ccacaucuuccacgucaaug

SEQ ID NO: 139439 - RNA, 20 nt, Artificial Sequence
  mmSKRIPTE0010218_Ddx17_2
  gRNA
gcggugcgagaacccuacgc

SEQ ID NO: 139440 - RNA, 20 nt, Artificial Sequence
  mmSKRIPTE0010219_Ddx17_3
  gRNA
ugcguagcguuaaguuggag

SEQ ID NO: 139441 - RNA, 20 nt, Artificial Sequence
  mmSKRIPTE0010220_Ddx17_4
  gRNA
ucuccgucaccgacguaaag

SEQ ID NO: 139442 - RNA, 20 nt, Artificial Sequence
  mmSKRIPTE0010221_Ddx17_5
  gRNA
aagaguacgugcauuuacgg

SEQ ID NO: 139443 - RNA, 20 nt, Artificial Sequence
  mmSKRIPTE0010222_Ddx17_6
  gRNA
ccacggauguagccucccgu

SEQ ID NO: 139444 - RNA, 20 nt, Artificial Sequence
  mmSKRIPTE0010223_Ddx17_7
  gRNA
auucccagauaacacccggg

SEQ ID NO: 139445 - RNA, 20 nt, Artificial Sequence
  mmSKRIPTE0010224_Ddx17_8
  gRNA
uggucggcccaccuuaaaca

SEQ ID NO: 139446 - RNA, 20 nt, Artificial Sequence
  mmSKRIPTE0010225_Ddx17_9
  gRNA
augcagcuuguggaccacag

SEQ ID NO: 139447 - RNA, 20 nt, Artificial Sequence
  mmSKRIPTE0010226_Ighv2-6_1
  gRNA
cugguagugauauggaguga

SEQ ID NO: 139448 - RNA, 20 nt, Artificial Sequence
  mmSKRIPTE0010227_Ighv2-6_2
  gRNA
agcaaccuucugucaccagg

SEQ ID NO: 139449 - RNA, 20 nt, Artificial Sequence
  mmSKRIPTE0010228_Ighv2-6_3
  gRNA
ccaucacaugcaccgucuca

SEQ ID NO: 139450 - RNA, 20 nt, Artificial Sequence
  mmSKRIPTE0010229_Ighv2-6_4
  gRNA
gggggcgcugaggacccaaa

SEQ ID NO: 139451 - RNA, 20 nt, Artificial Sequence
  mmSKRIPTE0010230_Ighv2-6_5
  gRNA
acauggcugugucaucaguu

SEQ ID NO: 139452 - RNA, 20 nt, Artificial Sequence
  mmSKRIPTE0010231_Gm13271_1
  gRNA
augcugaagccugaucauag

SEQ ID NO: 139453 - RNA, 20 nt, Artificial Sequence
  mmSKRIPTE0010232_Gm13271_2
  gRNA
gaugcuucggggcacgagca

SEQ ID NO: 139454 - RNA, 20 nt, Artificial Sequence
  mmSKRIPTE0010233_Gm13271_3
  gRNA
cagaagaaaugggugugcau

SEQ ID NO: 139455 - RNA, 20 nt, Artificial Sequence
  mmSKRIPTE0010234_Gm13271_4
  gRNA
agaguuuacuuagagcuccu

SEQ ID NO: 139456 - RNA, 20 nt, Artificial Sequence
  mmSKRIPTE0010235_Gm13271_5
  gRNA
gaugaggagauggcccgugc

SEQ ID NO: 139457 - RNA, 20 nt, Artificial Sequence
  mmSKRIPTE0010236_Gm13271_6
  gRNA
cccucuagagcaccaucugc

SEQ ID NO: 139458 - RNA, 20 nt, Artificial Sequence
  mmSKRIPTE0010237_Gm13271_7
  gRNA
cggagcucugcuaggaagcg

SEQ ID NO: 139459 - RNA, 20 nt, Artificial Sequence
  mmSKRIPTE0010238_Gm13271_8
  gRNA
gagacauccauugcugcacc

SEQ ID NO: 139460 - RNA, 20 nt, Artificial Sequence
  mmSKRIPTE0010239_Gm13271_9
  gRNA
gauucagccccagaagaaau

SEQ ID NO: 139461 - RNA, 20 nt, Artificial Sequence
  mmSKRIPTE0010240_Ighv2-9_1
  gRNA
uaaaagccaaggccuagcug

SEQ ID NO: 139462 - RNA, 20 nt, Artificial Sequence
  mmSKRIPTE0010241_Ighv2-9_2
  gRNA
cucugaugggggcucuagug

SEQ ID NO: 139463 - RNA, 20 nt, Artificial Sequence
  mmSKRIPTE0010242_Ighv2-9_3
  gRNA
ugaugauauugcuugucccc

SEQ ID NO: 139464 - RNA, 20 nt, Artificial Sequence
  mmSKRIPTE0010243_Ighv2-9_4
  gRNA
agaaccaagaaguucuuccc

SEQ ID NO: 139465 - RNA, 20 nt, Artificial Sequence
  mmSKRIPTE0010244_Ighv2-9_5
  gRNA
cagagguaaucucaggcaca

SEQ ID NO: 139466 - RNA, 20 nt, Artificial Sequence
  mmSKRIPTE0010245_Ighv2-9_6
  gRNA
aacacagguucacauagcau

SEQ ID NO: 139467 - RNA, 20 nt, Artificial Sequence
  mmSKRIPTE0010246_Ighv2-9_7
  gRNA
uccugagcauccuuguaggg

SEQ ID NO: 139468 - RNA, 20 nt, Artificial Sequence
  mmSKRIPTE0010247_Ighv2-9_8
  gRNA
uacagcuuggaaaugcaacc

SEQ ID NO: 139469 - RNA, 20 nt, Artificial Sequence
  mmSKRIPTE0010248_Ighv2-9_9
  gRNA
caaagggcuacuuugcauug

SEQ ID NO: 139470 - RNA, 20 nt, Artificial Sequence
  mmSKRIPTE0010249_Ighv1-64_1
  gRNA
ccaaguccuaaucuuguccg

SEQ ID NO: 139471 - RNA, 20 nt, Artificial Sequence
  mmSKRIPTE0010250_Ighv1-64_2
  gRNA
uucuucuccagcaggaguag

SEQ ID NO: 139472 - RNA, 20 nt, Artificial Sequence
  mmSKRIPTE0010251_Ighv1-64_3
  gRNA
agaaaaacggacuaucugaa

SEQ ID NO: 139473 - RNA, 20 nt, Artificial Sequence
  mmSKRIPTE0010252_Ighv1-64_4
  gRNA
gagggguaacaaacugcccu

SEQ ID NO: 139474 - RNA, 20 nt, Artificial Sequence
  mmSKRIPTE0010253_Ighv1-64_5
  gRNA
ggaaugauucauccuaauag

SEQ ID NO: 139475 - RNA, 20 nt, Artificial Sequence
  mmSKRIPTE0010254_Ifna16_1
  gRNA
auggucuucagaagaccuag

SEQ ID NO: 139476 - RNA, 20 nt, Artificial Sequence
  mmSKRIPTE0010255_Ifna16_2
  gRNA
agccaucccuguccuaagug

SEQ ID NO: 139477 - RNA, 20 nt, Artificial Sequence
  mmSKRIPTE0010256_Ifna16_3
  gRNA
cauuuguaucaagaguguca

SEQ ID NO: 139478 - RNA, 20 nt, Artificial Sequence
  mmSKRIPTE0010257_Ifna16_4
  gRNA
gacaauuggaaaguuagagg

SEQ ID NO: 139479 - RNA, 20 nt, Artificial Sequence
  mmSKRIPTE0010258_Ifna16_5
  gRNA
uucuggcugugaugagcuac

SEQ ID NO: 139480 - RNA, 20 nt, Artificial Sequence
  mmSKRIPTE0010259_Ifna16_6
  gRNA
auuacaaaauguaucuagga

SEQ ID NO: 139481 - RNA, 20 nt, Artificial Sequence
  mmSKRIPTE0010260_Ifna16_7
  gRNA
gcaagccugucuagugcagc

SEQ ID NO: 139482 - RNA, 20 nt, Artificial Sequence
  mmSKRIPTE0010261_Ifna16_8
  gRNA
caggguauccaccuucuccu

SEQ ID NO: 139483 - RNA, 20 nt, Artificial Sequence
  mmSKRIPTE0010262_Ifna16_9
  gRNA
uucuuuacugaaaagcucag

SEQ ID NO: 139484 - RNA, 20 nt, Artificial Sequence
  mmSKRIPTE0010263_Ighv8-12_1
  gRNA
ugagugccaaggcuccguaa

SEQ ID NO: 139485 - RNA, 20 nt, Artificial Sequence
  mmSKRIPTE0010264_Ighv8-12_2
  gRNA
uaacauauuaauaaggaccu

SEQ ID NO: 139486 - RNA, 20 nt, Artificial Sequence
  mmSKRIPTE0010265_Ighv8-12_3
  gRNA
aagggguaugagucuaugau

SEQ ID NO: 139487 - RNA, 20 nt, Artificial Sequence
  mmSKRIPTE0010266_Ighv8-12_4
  gRNA
caaggauaccuccagaaacc

SEQ ID NO: 139488 - RNA, 20 nt, Artificial Sequence
  mmSKRIPTE0010267_Ighv8-12_5
  gRNA
gagauuugcauucccgccuc

SEQ ID NO: 139489 - RNA, 20 nt, Artificial Sequence
  mmSKRIPTE0010268_Ifna9_1
  gRNA
uaagacacaucuacauagga

SEQ ID NO: 139490 - RNA, 20 nt, Artificial Sequence
  mmSKRIPTE0010269_Ifna9_2
  gRNA
augccagaauuugcacagug

SEQ ID NO: 139491 - RNA, 20 nt, Artificial Sequence
  mmSKRIPTE0010270_Ifna9_3
  gRNA
ucuugguggugauaagcuac

SEQ ID NO: 139492 - RNA, 20 nt, Artificial Sequence
  mmSKRIPTE0010271_Ifna9_4
  gRNA
aagaaagcgaaaagaccagu

SEQ ID NO: 139493 - RNA, 20 nt, Artificial Sequence
  mmSKRIPTE0010272_Ifna9_5
  gRNA
caaagcacauuacugcaucu

SEQ ID NO: 139494 - RNA, 20 nt, Artificial Sequence
  mmSKRIPTE0010273_Ifna9_6
  gRNA
ggccagugcagaaugagucu

SEQ ID NO: 139495 - RNA, 20 nt, Artificial Sequence
  mmSKRIPTE0010274_Ifna9_7
  gRNA
cuucaagacucauaauggcu

SEQ ID NO: 139496 - RNA, 20 nt, Artificial Sequence
  mmSKRIPTE0010275_Ifna9_8
  gRNA
auauuucuucauagccagcu

SEQ ID NO: 139497 - RNA, 20 nt, Artificial Sequence
  mmSKRIPTE0010276_Ifna9_9
  gRNA
caaaauggagaggacucucc

SEQ ID NO: 139498 - RNA, 20 nt, Artificial Sequence
  mmSKRIPTE0010277_Ifnl3_1
  gRNA
acacuguggagcugccagug

SEQ ID NO: 139499 - RNA, 20 nt, Artificial Sequence
  mmSKRIPTE0010278_Ifnl3_2
  gRNA
ccuccgggaccucaagugug

SEQ ID NO: 139500 - RNA, 20 nt, Artificial Sequence
  mmSKRIPTE0010279_Ifnl3_3
  gRNA
agccaggugagucccgagaa

SEQ ID NO: 139501 - RNA, 20 nt, Artificial Sequence
  mmSKRIPTE0010280_Ifnl3_4
  gRNA
agggaacaucugagauguag

SEQ ID NO: 139502 - RNA, 20 nt, Artificial Sequence
  mmSKRIPTE0010281_Ifnl3_5
  gRNA
agggacucgggucucccuug

SEQ ID NO: 139503 - RNA, 20 nt, Artificial Sequence
  mmSKRIPTE0010282_Ifnl3_6
  gRNA
caaguggcuggagaacacug

SEQ ID NO: 139504 - RNA, 20 nt, Artificial Sequence
  mmSKRIPTE0010283_Ifnl3_7
  gRNA
caaaguggagaucauucuaa

SEQ ID NO: 139505 - RNA, 20 nt, Artificial Sequence
  mmSKRIPTE0010284_Ifnl3_8
  gRNA
gagacucacgauggcacccu

SEQ ID NO: 139506 - RNA, 20 nt, Artificial Sequence
  mmSKRIPTE0010285_Ighv3-3_1
  gRNA
gaaaagaggguguagccuaa

SEQ ID NO: 139507 - RNA, 20 nt, Artificial Sequence
  mmSKRIPTE0010286_Ighv3-3_2
  gRNA
auggcaacacuaaccaggaa

SEQ ID NO: 139508 - RNA, 20 nt, Artificial Sequence
  mmSKRIPTE0010287_Ighv3-3_3
  gRNA
uugccccauacacguagcac

SEQ ID NO: 139509 - RNA, 20 nt, Artificial Sequence
  mmSKRIPTE0010288_Ighv3-3_4
  gRNA
acguucgacuuucaagagau

SEQ ID NO: 139510 - RNA, 20 nt, Artificial Sequence
  mmSKRIPTE0010289_Ighv3-3_5
  gRNA
gcucauaucuuucucacugg

SEQ ID NO: 139511 - RNA, 20 nt, Artificial Sequence
  mmSKRIPTE0010290_Ighv3-3_6
  gRNA
aucggguacacauucuacag

SEQ ID NO: 139512 - RNA, 20 nt, Artificial Sequence
  mmSKRIPTE0010291_Ighv3-3_7
  gRNA
aagcagcucuguaccaccag

SEQ ID NO: 139513 - RNA, 20 nt, Artificial Sequence
  mmSKRIPTE0010292_Ighv3-3_8
  gRNA
ggagaagccaguaacagugc

SEQ ID NO: 139514 - RNA, 20 nt, Artificial Sequence
  mmSKRIPTE0010293_Ighv3-3_9
  gRNA
gugucugagaaggucucacc

SEQ ID NO: 139515 - RNA, 20 nt, Artificial Sequence
  mmSKRIPTE0010294_Ighv9-2_1
  gRNA
aacucccugucucauaugug

SEQ ID NO: 139516 - RNA, 20 nt, Artificial Sequence
  mmSKRIPTE0010295_Ighv9-2_2
  gRNA
agccccugugaaaagaacac

SEQ ID NO: 139517 - RNA, 20 nt, Artificial Sequence
  mmSKRIPTE0010296_Ighv9-2_3
  gRNA
uugaagucgucagcauaugu

SEQ ID NO: 139518 - RNA, 20 nt, Artificial Sequence
  mmSKRIPTE0010297_Ighv9-2_4
  gRNA
agcccaagucuuacacauca

SEQ ID NO: 139519 - RNA, 20 nt, Artificial Sequence
  mmSKRIPTE0010298_Ighv9-2_5
  gRNA
caucagaauaaagaguucca

SEQ ID NO: 139520 - RNA, 20 nt, Artificial Sequence
  mmSKRIPTE0010299_Ighv5-9-1_1
  gRNA
cgacccuguagcucugacag

SEQ ID NO: 139521 - RNA, 20 nt, Artificial Sequence
  mmSKRIPTE0010300_Ighv5-9-1_2
  gRNA
aguacucaucacugaacgug

SEQ ID NO: 139522 - RNA, 20 nt, Artificial Sequence
  mmSKRIPTE0010301_Ighv5-9-1_3
  gRNA
cuaaaaccugcagagcaucc

SEQ ID NO: 139523 - RNA, 20 nt, Artificial Sequence
  mmSKRIPTE0010302_Ighv5-9-1_4
  gRNA
uugacugugaguugaagauu

SEQ ID NO: 139524 - RNA, 20 nt, Artificial Sequence
  mmSKRIPTE0010303_Ighv5-9-1_5
  gRNA
accugcaaacagagaauacu

SEQ ID NO: 139525 - RNA, 20 nt, Artificial Sequence
  mmSKRIPTE0010304_Ighv5-9-1_6
  gRNA
accccagagcaugguauagu

SEQ ID NO: 139526 - RNA, 20 nt, Artificial Sequence
  mmSKRIPTE0010305_Ighv4-1_1
  gRNA
aggcugcccagacacaugag

SEQ ID NO: 139527 - RNA, 20 nt, Artificial Sequence
  mmSKRIPTE0010306_Ighv4-1_2
  gRNA
guuggguucggcgggcucca

SEQ ID NO: 139528 - RNA, 20 nt, Artificial Sequence
  mmSKRIPTE0010307_Ighv4-1_3
  gRNA
ucuacuaaaaucgauuccug

SEQ ID NO: 139529 - RNA, 20 nt, Artificial Sequence
  mmSKRIPTE0010308_Ighv4-1_4
  gRNA
aaacuaugcaccaucucuaa

SEQ ID NO: 139530 - RNA, 20 nt, Artificial Sequence
  mmSKRIPTE0010309_Ighv4-1_5
  gRNA
acagaacacaggaucacucc

SEQ ID NO: 139531 - RNA, 20 nt, Artificial Sequence
  mmSKRIPTE0010310_Ighv4-1_6
  gRNA
gcaccaggccaccuccagac

SEQ ID NO: 139532 - RNA, 20 nt, Artificial Sequence
  mmSKRIPTE0010311_Ighv4-1_7
  gRNA
uuaaauguacucauggaguc

SEQ ID NO: 139533 - RNA, 20 nt, Artificial Sequence
  mmSKRIPTE0010312_Iglc2_1
  gRNA
cccaccucuccuagccacag

SEQ ID NO: 139534 - RNA, 20 nt, Artificial Sequence
  mmSKRIPTE0010313_Iglc2_2
  gRNA
agcuuugaaacuacuuaccu

SEQ ID NO: 139535 - RNA, 20 nt, Artificial Sequence
  mmSKRIPTE0010314_Iglc2_3
  gRNA
aaagugccagguaaaaagcg

SEQ ID NO: 139536 - RNA, 20 nt, Artificial Sequence
  mmSKRIPTE0010315_Iglc2_4
  gRNA
cuuugaauuuacaauauggg

SEQ ID NO: 139537 - RNA, 20 nt, Artificial Sequence
  mmSKRIPTE0010316_Iglc2_5
  gRNA
cugggucucuaaaagcugca

SEQ ID NO: 139538 - RNA, 20 nt, Artificial Sequence
  mmSKRIPTE0010317_Iglc2_6
  gRNA
ggaaaucagacacaccagug

SEQ ID NO: 139539 - RNA, 20 nt, Artificial Sequence
  mmSKRIPTE0010318_Iglc2_7
  gRNA
aagacccuugcaagacaaca

SEQ ID NO: 139540 - RNA, 20 nt, Artificial Sequence
  mmSKRIPTE0010319_Iglc2_8
  gRNA
gaccugugcgaauaaaagaa

SEQ ID NO: 139541 - RNA, 20 nt, Artificial Sequence
  mmSKRIPTE0010320_Iglc2_9
  gRNA
ggccacugucacaccacucg

SEQ ID NO: 139542 - RNA, 20 nt, Artificial Sequence
  mmSKRIPTE0010321_Ighv1-39_1
  gRNA
ucuuaagauccuaguccacc

SEQ ID NO: 139543 - RNA, 20 nt, Artificial Sequence
  mmSKRIPTE0010322_Ighv1-39_2
  gRNA
aguuacuugggacaagcugc

SEQ ID NO: 139544 - RNA, 20 nt, Artificial Sequence
  mmSKRIPTE0010323_Ighv1-39_3
  gRNA
cuaagucuugucaguucuaa

SEQ ID NO: 139545 - RNA, 20 nt, Artificial Sequence
  mmSKRIPTE0010324_Ighv1-39_4
  gRNA
cuagacauauguugauuuca

SEQ ID NO: 139546 - RNA, 20 nt, Artificial Sequence
  mmSKRIPTE0010325_Ighv1-39_5
  gRNA
uguaggcugugcuggaagau

SEQ ID NO: 139547 - RNA, 20 nt, Artificial Sequence
  mmSKRIPTE0010326_Ncor1_1
  gRNA
aacacggaggacgguaacca

SEQ ID NO: 139548 - RNA, 20 nt, Artificial Sequence
  mmSKRIPTE0010327_Ncor1_2
  gRNA
cuggauccaagugcgugggu

SEQ ID NO: 139549 - RNA, 20 nt, Artificial Sequence
  mmSKRIPTE0010328_Ncor1_3
  gRNA
gcuucccagcuuacauugag

SEQ ID NO: 139550 - RNA, 20 nt, Artificial Sequence
  mmSKRIPTE0010329_Ncor1_4
  gRNA
cucaggacuaacgacaacac

SEQ ID NO: 139551 - RNA, 20 nt, Artificial Sequence
  mmSKRIPTE0010330_Ncor1_5
  gRNA
aagaagaauaaauuggcaug

SEQ ID NO: 139552 - RNA, 20 nt, Artificial Sequence
  mmSKRIPTE0010331_Ncor1_6
  gRNA
caacaugggagacguaucgu

SEQ ID NO: 139553 - RNA, 20 nt, Artificial Sequence
  mmSKRIPTE0010332_Ncor1_7
  gRNA
gaacuuguauuguggaguag

SEQ ID NO: 139554 - RNA, 20 nt, Artificial Sequence
  mmSKRIPTE0010333_Ncor1_8
  gRNA
cuuaaagggucucaagacca

SEQ ID NO: 139555 - RNA, 20 nt, Artificial Sequence
  mmSKRIPTE0010334_Ncor1_9
  gRNA
guucaaucccuaggauaagu

SEQ ID NO: 139556 - RNA, 20 nt, Artificial Sequence
  mmSKRIPTE0010335_Ifna14_1
  gRNA
agauggcagucugagcagug

SEQ ID NO: 139557 - RNA, 20 nt, Artificial Sequence
  mmSKRIPTE0010336_Ifna14_2
  gRNA
acucagcucaaugaccugca

SEQ ID NO: 139558 - RNA, 20 nt, Artificial Sequence
  mmSKRIPTE0010337_Ifna14_3
  gRNA
caaaguggaaaggacucucc

SEQ ID NO: 139559 - RNA, 20 nt, Artificial Sequence
  mmSKRIPTE0010338_Ifna14_4
  gRNA
ugacacuucugguaaaaaug

SEQ ID NO: 139560 - RNA, 20 nt, Artificial Sequence
  mmSKRIPTE0010339_Ifna14_5
  gRNA
guggaucuugcagaugucgc

SEQ ID NO: 139561 - RNA, 20 nt, Artificial Sequence
  mmSKRIPTE0010340_Ifna14_6
  gRNA
acaggcaccuccccugaccc

SEQ ID NO: 139562 - RNA, 20 nt, Artificial Sequence
  mmSKRIPTE0010341_Ifna14_7
  gRNA
gcuggucagcaacuuggcug

SEQ ID NO: 139563 - RNA, 20 nt, Artificial Sequence
  mmSKRIPTE0010342_Ifna14_8
  gRNA
gcgggaauccaaaguccuuc

SEQ ID NO: 139564 - RNA, 20 nt, Artificial Sequence
  mmSKRIPTE0010343_Ighv8-8_1
  gRNA
ugagugccaaaucuuccuaa

SEQ ID NO: 139565 - RNA, 20 nt, Artificial Sequence
  mmSKRIPTE0010344_Ighv8-8_2
  gRNA
auuccucaagaucgccaaug

SEQ ID NO: 139566 - RNA, 20 nt, Artificial Sequence
  mmSKRIPTE0010345_Ighv8-8_3
  gRNA
aacaucuaaauagggaccua

SEQ ID NO: 139567 - RNA, 20 nt, Artificial Sequence
  mmSKRIPTE0010346_Ighv8-8_4
  gRNA
ugagccgacucuucagggcu

SEQ ID NO: 139568 - RNA, 20 nt, Artificial Sequence
  mmSKRIPTE0010347_Ighv8-8_5
  gRNA
ccuuucaccuaagagcaaac

SEQ ID NO: 139569 - RNA, 20 nt, Artificial Sequence
  mmSKRIPTE0010348_Ighv16-1_1
  gRNA
aguacacagucuacucaaca

SEQ ID NO: 139570 - RNA, 20 nt, Artificial Sequence
  mmSKRIPTE0010349_Ighv16-1_2
  gRNA
guccugagcuccuuguggag

SEQ ID NO: 139571 - RNA, 20 nt, Artificial Sequence
  mmSKRIPTE0010350_Ighv16-1_3
  gRNA
ccauucuagccucaugccug

SEQ ID NO: 139572 - RNA, 20 nt, Artificial Sequence
  mmSKRIPTE0010351_Ighv16-1_4
  gRNA
cagucugagaaacgaagaca

SEQ ID NO: 139573 - RNA, 20 nt, Artificial Sequence
  mmSKRIPTE0010352_Ighv16-1_5
  gRNA
gacgugaguaaaagagucag

SEQ ID NO: 139574 - RNA, 20 nt, Artificial Sequence
  mmSKRIPTE0010353_Ighv16-1_6
  gRNA
aaucacugaauaggaagacc

SEQ ID NO: 139575 - RNA, 20 nt, Artificial Sequence
  mmSKRIPTE0010354_Ighv16-1_7
  gRNA
cacuuucagugaucauugga

SEQ ID NO: 139576 - RNA, 20 nt, Artificial Sequence
  mmSKRIPTE0010355_Ighv16-1_8
  gRNA
gagaguuuaguggacccucc

SEQ ID NO: 139577 - RNA, 20 nt, Artificial Sequence
  mmSKRIPTE0010356_Ighv16-1_9
  gRNA
aauacaaaccaugaugagag

SEQ ID NO: 139578 - RNA, 20 nt, Artificial Sequence
  mmSKRIPTE0010357_Ighv1-67_1
  gRNA
gucaugcaaagagucuagag

SEQ ID NO: 139579 - RNA, 20 nt, Artificial Sequence
  mmSKRIPTE0010358_Ighv1-67_2
  gRNA
ucacugauuaugcuaugcac

SEQ ID NO: 139580 - RNA, 20 nt, Artificial Sequence
  mmSKRIPTE0010359_Ighv1-67_3
  gRNA
cucaguaguaaauuugaggg

SEQ ID NO: 139581 - RNA, 20 nt, Artificial Sequence
  mmSKRIPTE0010360_Ighv1-67_4
  gRNA
acuugccagacugacaucug

SEQ ID NO: 139582 - RNA, 20 nt, Artificial Sequence
  mmSKRIPTE0010361_Ighv1-67_5
  gRNA
gaugauacagcuccaaccga

SEQ ID NO: 139583 - RNA, 20 nt, Artificial Sequence
  mmSKRIPTE0010362_Ighv1-67_6
  gRNA
cuacagucacaggaauacac

SEQ ID NO: 139584 - RNA, 20 nt, Artificial Sequence
  mmSKRIPTE0010363_Ighv1-67_7
  gRNA
ucagugaagauuuccugcaa

SEQ ID NO: 139585 - RNA, 20 nt, Artificial Sequence
  mmSKRIPTE0010364_Ighv1-67_8
  gRNA
cuauuucugaucaaaucuaa

SEQ ID NO: 139586 - RNA, 20 nt, Artificial Sequence
  mmSKRIPTE0010365_Hamp_1
  gRNA
gguaaaaaaccuagacaccu

SEQ ID NO: 139587 - RNA, 20 nt, Artificial Sequence
  mmSKRIPTE0010366_Hamp_2
  gRNA
aauaguggcgccaaacaggc

SEQ ID NO: 139588 - RNA, 20 nt, Artificial Sequence
  mmSKRIPTE0010367_Hamp_3
  gRNA
ugcuguaacaauucccagug

SEQ ID NO: 139589 - RNA, 20 nt, Artificial Sequence
  mmSKRIPTE0010368_Hamp_4
  gRNA
agaagagguauugaaucuug

SEQ ID NO: 139590 - RNA, 20 nt, Artificial Sequence
  mmSKRIPTE0010369_Hamp_5
  gRNA
gagggcaggaauaaauaaug

SEQ ID NO: 139591 - RNA, 20 nt, Artificial Sequence
  mmSKRIPTE0010370_Hamp_6
  gRNA
gugucaccuacagccagcag

SEQ ID NO: 139592 - RNA, 20 nt, Artificial Sequence
  mmSKRIPTE0010371_Hamp_7
  gRNA
aaugagucagagcaaaaugg

SEQ ID NO: 139593 - RNA, 20 nt, Artificial Sequence
  mmSKRIPTE0010372_Hamp_8
  gRNA
gcucaccuguugauggagau

SEQ ID NO: 139594 - RNA, 20 nt, Artificial Sequence
  mmSKRIPTE0010373_Hamp_9
  gRNA
uugcaagcccugcugaggac

SEQ ID NO: 139595 - RNA, 20 nt, Artificial Sequence
  mmSKRIPTE0010374_Ighv5-4_1
  gRNA
cuagguccaacuccggagca

SEQ ID NO: 139596 - RNA, 20 nt, Artificial Sequence
  mmSKRIPTE0010375_Ighv5-4_2
  gRNA
aaugugaggaacucgaaucc

SEQ ID NO: 139597 - RNA, 20 nt, Artificial Sequence
  mmSKRIPTE0010376_Ighv5-4_3
  gRNA
guaacuaccaccaucacuaa

SEQ ID NO: 139598 - RNA, 20 nt, Artificial Sequence
  mmSKRIPTE0010377_Ighv5-4_4
  gRNA
uucgccagacuccggaaaag

SEQ ID NO: 139599 - RNA, 20 nt, Artificial Sequence
  mmSKRIPTE0010378_Ighv5-4_5
  gRNA
cugaugauaacagauauaua

SEQ ID NO: 139600 - RNA, 20 nt, Artificial Sequence
  mmSKRIPTE0010379_Ighv2-6-8_1
  gRNA
gcaccugggaaaggauaccu

SEQ ID NO: 139601 - RNA, 20 nt, Artificial Sequence
  mmSKRIPTE0010380_Ighv2-6-8_2
  gRNA
gucacuggcacaguaguaca

SEQ ID NO: 139602 - RNA, 20 nt, Artificial Sequence
  mmSKRIPTE0010381_Ighv2-6-8_3
  gRNA
gggggcgcugaggauccaaa

SEQ ID NO: 139603 - RNA, 20 nt, Artificial Sequence
  mmSKRIPTE0010382_Ighv2-6-8_4
  gRNA
gucagcuaaugugugacuaa

SEQ ID NO: 139604 - RNA, 20 nt, Artificial Sequence
  mmSKRIPTE0010383_Ighv2-6-8_5
  gRNA
agaagcacaaaggugaucau

SEQ ID NO: 139605 - RNA, 20 nt, Artificial Sequence
  mmSKRIPTE0010384_Ighv6-7_1
  gRNA
accauaaagcucucacagag

SEQ ID NO: 139606 - RNA, 20 nt, Artificial Sequence
  mmSKRIPTE0010385_Ighv6-7_2
  gRNA
agaagcuuuauaaggauggg

SEQ ID NO: 139607 - RNA, 20 nt, Artificial Sequence
  mmSKRIPTE0010386_Ighv6-7_3
  gRNA
gagaguuucauggaccuccc

SEQ ID NO: 139608 - RNA, 20 nt, Artificial Sequence
  mmSKRIPTE0010387_Ighv6-7_4
  gRNA
cagaguggacauguaaccca

SEQ ID NO: 139609 - RNA, 20 nt, Artificial Sequence
  mmSKRIPTE0010388_Ighv6-7_5
  gRNA
agaccauuaaccauguacuu

SEQ ID NO: 139610 - RNA, 20 nt, Artificial Sequence
  mmSKRIPTE0010389_Ighv6-7_6
  gRNA
uaagcagucaaaauauacag

SEQ ID NO: 139611 - RNA, 20 nt, Artificial Sequence
  mmSKRIPTE0010390_Ighv6-7_7
  gRNA
guuaguaaaagugaauccag

SEQ ID NO: 139612 - RNA, 20 nt, Artificial Sequence
  mmSKRIPTE0010391_Ighv6-7_8
  gRNA
cuauuucaggaggucagggg

SEQ ID NO: 139613 - RNA, 20 nt, Artificial Sequence
  mmSKRIPTE0010392_Ighv6-7_9
  gRNA
aaagugggcucaugauaaag

SEQ ID NO: 139614 - RNA, 20 nt, Artificial Sequence
  mmSKRIPTE0010393_H2-T22_1
  gRNA
uagccgacgauuaugaacca

SEQ ID NO: 139615 - RNA, 20 nt, Artificial Sequence
  mmSKRIPTE0010394_H2-T22_2
  gRNA
gacaacaccgacagaguugg

SEQ ID NO: 139616 - RNA, 20 nt, Artificial Sequence
  mmSKRIPTE0010395_H2-T22_3
  gRNA
auccccaucucgaucucgag

SEQ ID NO: 139617 - RNA, 20 nt, Artificial Sequence
  mmSKRIPTE0010396_H2-T22_4
  gRNA
ggacaccauaaucccacccc

SEQ ID NO: 139618 - RNA, 20 nt, Artificial Sequence
  mmSKRIPTE0010397_H2-T22_5
  gRNA
aagaaaggaagucaugacgu

SEQ ID NO: 139619 - RNA, 20 nt, Artificial Sequence
  mmSKRIPTE0010398_H2-T22_6
  gRNA
uugggugagugagaccgggg

SEQ ID NO: 139620 - RNA, 20 nt, Artificial Sequence
  mmSKRIPTE0010399_H2-T22_7
  gRNA
cucgggacagcugaaaaagg

SEQ ID NO: 139621 - RNA, 20 nt, Artificial Sequence
  mmSKRIPTE0010400_H2-T22_8
  gRNA
uacauccuguuaccuaagua

SEQ ID NO: 139622 - RNA, 20 nt, Artificial Sequence
  mmSKRIPTE0010401_H2-T22_9
  gRNA
uucaaacccucaaugggaca

SEQ ID NO: 139623 - RNA, 20 nt, Artificial Sequence
  mmSKRIPTE0010402_Ifna13_1
  gRNA
ucuguaugagcaugauuugg

SEQ ID NO: 139624 - RNA, 20 nt, Artificial Sequence
  mmSKRIPTE0010403_Ifna13_2
  gRNA
uagggcguggaacaaaaaag

SEQ ID NO: 139625 - RNA, 20 nt, Artificial Sequence
  mmSKRIPTE0010404_Ifna13_3
  gRNA
aaugcccucuaacuucccaa

SEQ ID NO: 139626 - RNA, 20 nt, Artificial Sequence
  mmSKRIPTE0010405_Ifna13_4
  gRNA
cagcucaugaacaaaaggga

SEQ ID NO: 139627 - RNA, 20 nt, Artificial Sequence
  mmSKRIPTE0010406_Ifna13_5
  gRNA
gcugcaucagacaagcuuug

SEQ ID NO: 139628 - RNA, 20 nt, Artificial Sequence
  mmSKRIPTE0010407_Ifnl2_1
  gRNA
cacccgggaccucaagugug

SEQ ID NO: 139629 - RNA, 20 nt, Artificial Sequence
  mmSKRIPTE0010408_Ifnl2_2
  gRNA
aagaguggagaucauucuaa

SEQ ID NO: 139630 - RNA, 20 nt, Artificial Sequence
  mmSKRIPTE0010409_Ifnl2_3
  gRNA
agccaggugagucccaagaa

SEQ ID NO: 139631 - RNA, 20 nt, Artificial Sequence
  mmSKRIPTE0010410_Ifnl2_4
  gRNA
uguccacagugugagcccau

SEQ ID NO: 139632 - RNA, 20 nt, Artificial Sequence
  mmSKRIPTE0010411_Ifnl2_5
  gRNA
aggggacaucugagacauag

SEQ ID NO: 139633 - RNA, 20 nt, Artificial Sequence
  mmSKRIPTE0010412_Ifnl2_6
  gRNA
cugcagggccuggagcuaug

SEQ ID NO: 139634 - RNA, 20 nt, Artificial Sequence
  mmSKRIPTE0010413_Ifnl2_7
  gRNA
agaggugggaacugcaccuc

SEQ ID NO: 139635 - RNA, 20 nt, Artificial Sequence
  mmSKRIPTE0010414_Ifnl2_8
  gRNA
gagacucacgauggcauccu

SEQ ID NO: 139636 - RNA, 20 nt, Artificial Sequence
  mmSKRIPTE0010415_Ccl27a_1
  gRNA
uuaacgguccguuuccgggg

SEQ ID NO: 139637 - RNA, 20 nt, Artificial Sequence
  mmSKRIPTE0010416_Ccl27a_2
  gRNA
ccucaaucgcgacauguccg

SEQ ID NO: 139638 - RNA, 20 nt, Artificial Sequence
  mmSKRIPTE0010417_Ccl27a_3
  gRNA
cggcugcggcgcuaaaguca

SEQ ID NO: 139639 - RNA, 20 nt, Artificial Sequence
  mmSKRIPTE0010418_Ccl27a_4
  gRNA
gggauaccuucgcauucuau

SEQ ID NO: 139640 - RNA, 20 nt, Artificial Sequence
  mmSKRIPTE0010419_Ccl27a_5
  gRNA
ugauggaaggaagcguaggg

SEQ ID NO: 139641 - RNA, 20 nt, Artificial Sequence
  mmSKRIPTE0010420_Ccl27a_6
  gRNA
ggaacugcaggaggccgaug

SEQ ID NO: 139642 - RNA, 20 nt, Artificial Sequence
  mmSKRIPTE0010421_Ighv5-16_1
  gRNA
agaacauucagaaccagcag

SEQ ID NO: 139643 - RNA, 20 nt, Artificial Sequence
  mmSKRIPTE0010422_Ighv5-16_2
  gRNA
uuacauggcuuggguccgcc

SEQ ID NO: 139644 - RNA, 20 nt, Artificial Sequence
  mmSKRIPTE0010423_Ighv5-16_3
  gRNA
ucuguguucaguccugauca

SEQ ID NO: 139645 - RNA, 20 nt, Artificial Sequence
  mmSKRIPTE0010424_Ighv5-16_4
  gRNA
uccagaaaagggucuagaau

SEQ ID NO: 139646 - RNA, 20 nt, Artificial Sequence
  mmSKRIPTE0010425_Ighv5-16_5
  gRNA
uugccagagcugcagaauca

SEQ ID NO: 139647 - RNA, 20 nt, Artificial Sequence
  mmSKRIPTE0010426_Ighv5-16_6
  gRNA
caugcuuugaaguuugacuu

SEQ ID NO: 139648 - RNA, 20 nt, Artificial Sequence
  mmSKRIPTE0010427_Ighv5-16_7
  gRNA
uucaggucagaaaguucuug

SEQ ID NO: 139649 - RNA, 20 nt, Artificial Sequence
  mmSKRIPTE0010428_Ighv5-16_8
  gRNA
gguuggaauccucugucucu

SEQ ID NO: 139650 - RNA, 20 nt, Artificial Sequence
  mmSKRIPTE0010429_Ighv5-16_9
  gRNA
ggcugugcaggagaguuuca

SEQ ID NO: 139651 - RNA, 20 nt, Artificial Sequence
  mmSKRIPTE0010430_Ighv9-4_1
  gRNA
gagccucagaauguucucag

SEQ ID NO: 139652 - RNA, 20 nt, Artificial Sequence
  mmSKRIPTE0010431_Ighv9-4_2
  gRNA
cagucuuagauaucauggaa

SEQ ID NO: 139653 - RNA, 20 nt, Artificial Sequence
  mmSKRIPTE0010432_Ighv9-4_3
  gRNA
uauccaagcacagauccagu

SEQ ID NO: 139654 - RNA, 20 nt, Artificial Sequence
  mmSKRIPTE0010433_Ighv9-4_4
  gRNA
ggcuggauaaacacccacuc

SEQ ID NO: 139655 - RNA, 20 nt, Artificial Sequence
  mmSKRIPTE0010434_Ighv9-4_5
  gRNA
ucacaacugcuggaaugcag

SEQ ID NO: 139656 - RNA, 20 nt, Artificial Sequence
  mmSKRIPTE0010435_Ighv9-4_6
  gRNA
agaguguccgguuagucuca

SEQ ID NO: 139657 - RNA, 20 nt, Artificial Sequence
  mmSKRIPTE0010436_Ighv9-4_7
  gRNA
aaaugcuccaaugggaacca

SEQ ID NO: 139658 - RNA, 20 nt, Artificial Sequence
  mmSKRIPTE0010437_Ighv9-4_8
  gRNA
guauuugugguccauaauga

SEQ ID NO: 139659 - RNA, 20 nt, Artificial Sequence
  mmSKRIPTE0010438_Ighv9-4_9
  gRNA
gauaagcaaccucaaaaaug

SEQ ID NO: 139660 - RNA, 20 nt, Artificial Sequence
  mmSKRIPTE0010439_Ifna12_1
  gRNA
augccagaauuugagcagug

SEQ ID NO: 139661 - RNA, 20 nt, Artificial Sequence
  mmSKRIPTE0010440_Ifna12_2
  gRNA
ggagagaacugucauagacu

SEQ ID NO: 139662 - RNA, 20 nt, Artificial Sequence
  mmSKRIPTE0010441_Ifna12_3
  gRNA
aaugucaugucucucugcaa

SEQ ID NO: 139663 - RNA, 20 nt, Artificial Sequence
  mmSKRIPTE0010442_Ifna12_4
  gRNA
uaauuacuguugaaacauca

SEQ ID NO: 139664 - RNA, 20 nt, Artificial Sequence
  mmSKRIPTE0010443_Ifna12_5
  gRNA
cauauucucuucuugcaucu

SEQ ID NO: 139665 - RNA, 20 nt, Artificial Sequence
  mmSKRIPTE0010444_Ifnab_1
  gRNA
aaugacugguaucuuugaga

SEQ ID NO: 139666 - RNA, 20 nt, Artificial Sequence
  mmSKRIPTE0010445_Ifnab_2
  gRNA
uccaggagauucucuccacu

SEQ ID NO: 139667 - RNA, 20 nt, Artificial Sequence
  mmSKRIPTE0010446_Ifnab_3
  gRNA
gaaagugcugagccuagcca

SEQ ID NO: 139668 - RNA, 20 nt, Artificial Sequence
  mmSKRIPTE0010447_Ifnab_4
  gRNA
accaguagcucaucacugcc

SEQ ID NO: 139669 - RNA, 20 nt, Artificial Sequence
  mmSKRIPTE0010448_Ifnab_5
  gRNA
gaaaaccugucugaugcagg

SEQ ID NO: 139670 - RNA, 20 nt, Artificial Sequence
  mmSKRIPTE0010449_Ifnab_6
  gRNA
cugacuggguggaugacuga

SEQ ID NO: 139671 - RNA, 20 nt, Artificial Sequence
  mmSKRIPTE0010450_Ifnab_7
  gRNA
guuaaugaaaauucauucag

SEQ ID NO: 139672 - RNA, 20 nt, Artificial Sequence
  mmSKRIPTE0010451_Tsc22d4_1
  gRNA
gacccguggaguguuaaccg

SEQ ID NO: 139673 - RNA, 20 nt, Artificial Sequence
  mmSKRIPTE0010452_Tsc22d4_2
  gRNA
ccccagaacacugauacccg

SEQ ID NO: 139674 - RNA, 20 nt, Artificial Sequence
  mmSKRIPTE0010453_Tsc22d4_3
  gRNA
cuucaccacccggaaacggg

SEQ ID NO: 139675 - RNA, 20 nt, Artificial Sequence
  mmSKRIPTE0010454_Tsc22d4_4
  gRNA
ggggucaucccccauccgag

SEQ ID NO: 139676 - RNA, 20 nt, Artificial Sequence
  mmSKRIPTE0010455_Tsc22d4_5
  gRNA
ucagaucaccagcgucacca

SEQ ID NO: 139677 - RNA, 20 nt, Artificial Sequence
  mmSKRIPTE0010456_Tsc22d4_6
  gRNA
gagagccuuaucgucgaggu

SEQ ID NO: 139678 - RNA, 20 nt, Artificial Sequence
  mmSKRIPTE0010457_Tsc22d4_7
  gRNA
ggacagcgaugacgauaggu

SEQ ID NO: 139679 - RNA, 20 nt, Artificial Sequence
  mmSKRIPTE0010458_Tsc22d4_8
  gRNA
uaucugaagccccucguccg

SEQ ID NO: 139680 - RNA, 20 nt, Artificial Sequence
  mmSKRIPTE0010459_Tsc22d4_9
  gRNA
cguccgcaucucacucugcg

SEQ ID NO: 139681 - RNA, 20 nt, Artificial Sequence
  mmSKRIPTE0010460_NTC_1
  gRNA
aaaaaguccgcgauuacguc

SEQ ID NO: 139682 - RNA, 20 nt, Artificial Sequence
  mmSKRIPTE0010461_NTC_2
  gRNA
aaaacggcucgaucggugau

SEQ ID NO: 139683 - RNA, 20 nt, Artificial Sequence
  mmSKRIPTE0010462_NTC_3
  gRNA
aaaacguaauuauaccgagc

SEQ ID NO: 139684 - RNA, 20 nt, Artificial Sequence
  mmSKRIPTE0010463_NTC_4
  gRNA
aaaauugcaccuucccggcc

SEQ ID NO: 139685 - RNA, 20 nt, Artificial Sequence
  mmSKRIPTE0010464_NTC_5
  gRNA
aaacccccgcgcggagcguc

SEQ ID NO: 139686 - RNA, 20 nt, Artificial Sequence
  mmSKRIPTE0010465_NTC_6
  gRNA
aaaccuagcguagauucggc

SEQ ID NO: 139687 - RNA, 20 nt, Artificial Sequence
  mmSKRIPTE0010466_NTC_7
  gRNA
aaacgaggcuguucguacac

SEQ ID NO: 139688 - RNA, 20 nt, Artificial Sequence
  mmSKRIPTE0010467_NTC_8
  gRNA
aaacucauacguagcgaauc

SEQ ID NO: 139689 - RNA, 20 nt, Artificial Sequence
  mmSKRIPTE0010468_NTC_9
  gRNA
aaacucccgugucaaccgau

SEQ ID NO: 139690 - RNA, 20 nt, Artificial Sequence
  mmSKRIPTE0010469_NTC_10
  gRNA
aaagacgugcauucagcgag

SEQ ID NO: 139691 - RNA, 20 nt, Artificial Sequence
  mmSKRIPTE0010470_NTC_11
  gRNA
aacauguuaagucgcguuau

SEQ ID NO: 139692 - RNA, 20 nt, Artificial Sequence
  mmSKRIPTE0010471_NTC_12
  gRNA
aaccagcauuugaccgcgcu

SEQ ID NO: 139693 - RNA, 20 nt, Artificial Sequence
  mmSKRIPTE0010472_NTC_13
  gRNA
aaccccggcugucaucgccg

SEQ ID NO: 139694 - RNA, 20 nt, Artificial Sequence
  mmSKRIPTE0010473_NTC_14
  gRNA
aacccgccggaacaaucagc

SEQ ID NO: 139695 - RNA, 20 nt, Artificial Sequence
  mmSKRIPTE0010474_NTC_15
  gRNA
aaccggcugcgcguuugcaa

SEQ ID NO: 139696 - RNA, 20 nt, Artificial Sequence
  mmSKRIPTE0010475_NTC_16
  gRNA
aaccguacugcgaggagcau

SEQ ID NO: 139697 - RNA, 20 nt, Artificial Sequence
  mmSKRIPTE0010476_NTC_17
  gRNA
aaccucgucucauguacgaa

SEQ ID NO: 139698 - RNA, 20 nt, Artificial Sequence
  mmSKRIPTE0010477_NTC_18
  gRNA
aacgccccggauuucguuga

SEQ ID NO: 139699 - RNA, 20 nt, Artificial Sequence
  mmSKRIPTE0010478_NTC_19
  gRNA
aacggcugcgcccgcggcaa

SEQ ID NO: 139700 - RNA, 20 nt, Artificial Sequence
  mmSKRIPTE0010479_NTC_20
  gRNA
aacgggcgcaauacccuuuu

SEQ ID NO: 139701 - RNA, 20 nt, Artificial Sequence
  mmSKRIPTE0010480_NTC_21
  gRNA
aacgguagcguacccgugaa

SEQ ID NO: 139702 - RNA, 20 nt, Artificial Sequence
  mmSKRIPTE0010481_NTC_22
  gRNA
aacggucaaauccgugaggg

SEQ ID NO: 139703 - RNA, 20 nt, Artificial Sequence
  mmSKRIPTE0010482_NTC_23
  gRNA
aacgucaccaaccucgaucc

SEQ ID NO: 139704 - RNA, 20 nt, Artificial Sequence
  mmSKRIPTE0010483_NTC_24
  gRNA
aacguuauagcuucgucucu

SEQ ID NO: 139705 - RNA, 20 nt, Artificial Sequence
  mmSKRIPTE0010484_NTC_25
  gRNA
aacuaacucacuacgcacga

SEQ ID NO: 139706 - RNA, 20 nt, Artificial Sequence
  mmSKRIPTE0010485_NTC_26
  gRNA
aacuccucaucguacgcuaa

SEQ ID NO: 139707 - RNA, 20 nt, Artificial Sequence
  mmSKRIPTE0010486_NTC_27
  gRNA
aacucgcgugggaaguccgg

SEQ ID NO: 139708 - RNA, 20 nt, Artificial Sequence
  mmSKRIPTE0010487_NTC_28
  gRNA
aacuuauacguaaucugauc

SEQ ID NO: 139709 - RNA, 20 nt, Artificial Sequence
  mmSKRIPTE0010488_NTC_29
  gRNA
aagacuccuacguaucgagc

SEQ ID NO: 139710 - RNA, 20 nt, Artificial Sequence
  mmSKRIPTE0010489_NTC_30
  gRNA
aagcacaagaacgguccgcc

SEQ ID NO: 139711 - RNA, 20 nt, Artificial Sequence
  mmSKRIPTE0010490_NTC_31
  gRNA
aagcagcgacuacucgacgc

SEQ ID NO: 139712 - RNA, 20 nt, Artificial Sequence
  mmSKRIPTE0010491_NTC_32
  gRNA
aagccuaacggagcucgcgg

SEQ ID NO: 139713 - RNA, 20 nt, Artificial Sequence
  mmSKRIPTE0010492_NTC_33
  gRNA
aagccuacuucaccggucgg

SEQ ID NO: 139714 - RNA, 20 nt, Artificial Sequence
  mmSKRIPTE0010493_NTC_34
  gRNA
aagcgagccgcagaccguuu

SEQ ID NO: 139715 - RNA, 20 nt, Artificial Sequence
  mmSKRIPTE0010494_NTC_35
  gRNA
aagcguaccccacucguuaa

SEQ ID NO: 139716 - RNA, 20 nt, Artificial Sequence
  mmSKRIPTE0010495_NTC_36
  gRNA
aagcgugagauucaccgccg

SEQ ID NO: 139717 - RNA, 20 nt, Artificial Sequence
  mmSKRIPTE0010496_NTC_37
  gRNA
aaggccuuaacacgucgacc

SEQ ID NO: 139718 - RNA, 20 nt, Artificial Sequence
  mmSKRIPTE0010497_NTC_38
  gRNA
aaggcguaaacgaguacacg

SEQ ID NO: 139719 - RNA, 20 nt, Artificial Sequence
  mmSKRIPTE0010498_NTC_39
  gRNA
aaggguaaguacaguaucgu

SEQ ID NO: 139720 - RNA, 20 nt, Artificial Sequence
  mmSKRIPTE0010499_NTC_40
  gRNA
aaguccccuucgggaacucc

SEQ ID NO: 139721 - RNA, 20 nt, Artificial Sequence
  mmSKRIPTE0010500_NTC_41
  gRNA
aagucuaugcggggcucgua

SEQ ID NO: 139722 - RNA, 20 nt, Artificial Sequence
  mmSKRIPTE0010501_NTC_42
  gRNA
aauaagccuacccggcgaga

SEQ ID NO: 139723 - RNA, 20 nt, Artificial Sequence
  mmSKRIPTE0010502_NTC_43
  gRNA
aauaccguaccgacucagug

SEQ ID NO: 139724 - RNA, 20 nt, Artificial Sequence
  mmSKRIPTE0010503_NTC_44
  gRNA
aauaggaacuccgcacccga

SEQ ID NO: 139725 - RNA, 20 nt, Artificial Sequence
  mmSKRIPTE0010504_NTC_45
  gRNA
aaucaaccgugauagucucg

SEQ ID NO: 139726 - RNA, 20 nt, Artificial Sequence
  mmSKRIPTE0010505_NTC_46
  gRNA
aaucaccgacaacguaagac

SEQ ID NO: 139727 - RNA, 20 nt, Artificial Sequence
  mmSKRIPTE0010506_NTC_47
  gRNA
aaugaagcaccgauugcgga

SEQ ID NO: 139728 - RNA, 20 nt, Artificial Sequence
  mmSKRIPTE0010507_NTC_48
  gRNA
aaugagcgucucucgaucgc

SEQ ID NO: 139729 - RNA, 20 nt, Artificial Sequence
  mmSKRIPTE0010508_NTC_49
  gRNA
aaugagcuucgaguucgucu

SEQ ID NO: 139730 - RNA, 20 nt, Artificial Sequence
  mmSKRIPTE0010509_NTC_50
  gRNA
aaugcugcguacgauaaccg

SEQ ID NO: 139731 - RNA, 20 nt, Artificial Sequence
  mmSKRIPTE0010510_NTC_51
  gRNA
aauucugagauuccgcggcu

SEQ ID NO: 139732 - RNA, 20 nt, Artificial Sequence
  mmSKRIPTE0010511_NTC_52
  gRNA
aauugucugaucgcgccaua

SEQ ID NO: 139733 - RNA, 20 nt, Artificial Sequence
  mmSKRIPTE0010512_NTC_53
  gRNA
aauuuuuucggaaucuagcg

SEQ ID NO: 139734 - RNA, 20 nt, Artificial Sequence
  mmSKRIPTE0010513_NTC_54
  gRNA
acaacaauuacuggccgcga

SEQ ID NO: 139735 - RNA, 20 nt, Artificial Sequence
  mmSKRIPTE0010514_NTC_55
  gRNA
acaacacgccgacacgucua

SEQ ID NO: 139736 - RNA, 20 nt, Artificial Sequence
  mmSKRIPTE0010515_NTC_56
  gRNA
acaauucgguuuaugcgcgu

SEQ ID NO: 139737 - RNA, 20 nt, Artificial Sequence
  mmSKRIPTE0010516_NTC_57
  gRNA
acacaaacuggucguagaug

SEQ ID NO: 139738 - RNA, 20 nt, Artificial Sequence
  mmSKRIPTE0010517_NTC_58
  gRNA
acacccguguaugcaccggg

SEQ ID NO: 139739 - RNA, 20 nt, Artificial Sequence
  mmSKRIPTE0010518_NTC_59
  gRNA
acacgaccgaccgguggaau

SEQ ID NO: 139740 - RNA, 20 nt, Artificial Sequence
  mmSKRIPTE0010519_NTC_60
  gRNA
acacgucuucggcuauacgc

SEQ ID NO: 139741 - RNA, 20 nt, Artificial Sequence
  mmSKRIPTE0010520_NTC_61
  gRNA
acagaccgaauaaccgacga

SEQ ID NO: 139742 - RNA, 20 nt, Artificial Sequence
  mmSKRIPTE0010521_NTC_62
  gRNA
acagagucgugugccgaacg

SEQ ID NO: 139743 - RNA, 20 nt, Artificial Sequence
  mmSKRIPTE0010522_NTC_63
  gRNA
acagcaggggccgcgaauaa

SEQ ID NO: 139744 - RNA, 20 nt, Artificial Sequence
  mmSKRIPTE0010523_NTC_64
  gRNA
acagcggccuaauacuucgc

SEQ ID NO: 139745 - RNA, 20 nt, Artificial Sequence
  mmSKRIPTE0010524_NTC_65
  gRNA
accaacgcuacgaucccgga

SEQ ID NO: 139746 - RNA, 20 nt, Artificial Sequence
  mmSKRIPTE0010525_NTC_66
  gRNA
accaauaacggguacaaguc

SEQ ID NO: 139747 - RNA, 20 nt, Artificial Sequence
  mmSKRIPTE0010526_NTC_67
  gRNA
accaccgugccggggacgcg

SEQ ID NO: 139748 - RNA, 20 nt, Artificial Sequence
  mmSKRIPTE0010527_NTC_68
  gRNA
accaggacugccgcgugagg

SEQ ID NO: 139749 - RNA, 20 nt, Artificial Sequence
  mmSKRIPTE0010528_NTC_69
  gRNA
accaggcgcggaccgcacau

SEQ ID NO: 139750 - RNA, 20 nt, Artificial Sequence
  mmSKRIPTE0010529_NTC_70
  gRNA
accauacggggucuugucga

SEQ ID NO: 139751 - RNA, 20 nt, Artificial Sequence
  mmSKRIPTE0010530_NTC_71
  gRNA
accauaguuucaaccugcgg

SEQ ID NO: 139752 - RNA, 20 nt, Artificial Sequence
  mmSKRIPTE0010531_NTC_72
  gRNA
accauccgauauuacgagca

SEQ ID NO: 139753 - RNA, 20 nt, Artificial Sequence
  mmSKRIPTE0010532_NTC_73
  gRNA
accaugaugucaccgccgca

SEQ ID NO: 139754 - RNA, 20 nt, Artificial Sequence
  mmSKRIPTE0010533_NTC_74
  gRNA
acccacguauguacucggga

SEQ ID NO: 139755 - RNA, 20 nt, Artificial Sequence
  mmSKRIPTE0010534_NTC_75
  gRNA
acccagauucgcauucggau

SEQ ID NO: 139756 - RNA, 20 nt, Artificial Sequence
  mmSKRIPTE0010535_NTC_76
  gRNA
acccauccccgcguccgaga

SEQ ID NO: 139757 - RNA, 20 nt, Artificial Sequence
  mmSKRIPTE0010536_NTC_77
  gRNA
acccaucgggugcgauaugg

SEQ ID NO: 139758 - RNA, 20 nt, Artificial Sequence
  mmSKRIPTE0010537_NTC_78
  gRNA
acccgcauaugccgccuaag

SEQ ID NO: 139759 - RNA, 20 nt, Artificial Sequence
  mmSKRIPTE0010538_NTC_79
  gRNA
acccuagccucaucgcgacc

SEQ ID NO: 139760 - RNA, 20 nt, Artificial Sequence
  mmSKRIPTE0010539_NTC_80
  gRNA
accgcacguucucgcagaga

SEQ ID NO: 139761 - RNA, 20 nt, Artificial Sequence
  mmSKRIPTE0010540_NTC_81
  gRNA
accgcgcaucauugacggug

SEQ ID NO: 139762 - RNA, 20 nt, Artificial Sequence
  mmSKRIPTE0010541_NTC_82
  gRNA
accggacugcgauaugccgu

SEQ ID NO: 139763 - RNA, 20 nt, Artificial Sequence
  mmSKRIPTE0010542_NTC_83
  gRNA
accggaugugggcgccucuc

SEQ ID NO: 139764 - RNA, 20 nt, Artificial Sequence
  mmSKRIPTE0010543_NTC_84
  gRNA
accggucgaagucugggauu

SEQ ID NO: 139765 - RNA, 20 nt, Artificial Sequence
  mmSKRIPTE0010544_NTC_85
  gRNA
accgguucagccgccggaac

SEQ ID NO: 139766 - RNA, 20 nt, Artificial Sequence
  mmSKRIPTE0010545_NTC_86
  gRNA
accguacaagacucgcucca

SEQ ID NO: 139767 - RNA, 20 nt, Artificial Sequence
  mmSKRIPTE0010546_NTC_87
  gRNA
accgucucuauuauacggca

SEQ ID NO: 139768 - RNA, 20 nt, Artificial Sequence
  mmSKRIPTE0010547_NTC_88
  gRNA
accgucugauguucccggcu

SEQ ID NO: 139769 - RNA, 20 nt, Artificial Sequence
  mmSKRIPTE0010548_NTC_89
  gRNA
accguuguuuccgucgaaac

SEQ ID NO: 139770 - RNA, 20 nt, Artificial Sequence
  mmSKRIPTE0010549_NTC_90
  gRNA
accucgugcaaaucgguggc

SEQ ID NO: 139771 - RNA, 20 nt, Artificial Sequence
  mmSKRIPTE0010550_NTC_91
  gRNA
accuuguguucgacgguagg

SEQ ID NO: 139772 - RNA, 20 nt, Artificial Sequence
  mmSKRIPTE0010551_NTC_92
  gRNA
acgacgagagauacuuaggc

SEQ ID NO: 139773 - RNA, 20 nt, Artificial Sequence
  mmSKRIPTE0010552_NTC_93
  gRNA
acgacguccgcuguguguau

SEQ ID NO: 139774 - RNA, 20 nt, Artificial Sequence
  mmSKRIPTE0010553_NTC_94
  gRNA
acgaggagaagucgaguauu

SEQ ID NO: 139775 - RNA, 20 nt, Artificial Sequence
  mmSKRIPTE0010554_NTC_95
  gRNA
acgcaagcggaacgcgucua

SEQ ID NO: 139776 - RNA, 20 nt, Artificial Sequence
  mmSKRIPTE0010555_NTC_96
  gRNA
acgcacccauacaggcgcuu

SEQ ID NO: 139777 - RNA, 20 nt, Artificial Sequence
  mmSKRIPTE0010556_NTC_97
  gRNA
acgcgaagugucgcagagug

SEQ ID NO: 139778 - RNA, 20 nt, Artificial Sequence
  mmSKRIPTE0010557_NTC_98
  gRNA
acgcuauaguguacgucuaa

SEQ ID NO: 139779 - RNA, 20 nt, Artificial Sequence
  mmSKRIPTE0010558_NTC_99
  gRNA
acgcucuuggcagauaaucg

SEQ ID NO: 139780 - RNA, 20 nt, Artificial Sequence
  mmSKRIPTE0010559_NTC_100
  gRNA
acgcuguucguaaccgcggg

SEQ ID NO: 139781 - RNA, 20 nt, Artificial Sequence
  mmSKRIPTE0010560_NTC_101
  gRNA
acggaacccgaucggaacgg

SEQ ID NO: 139782 - RNA, 20 nt, Artificial Sequence
  mmSKRIPTE0010561_NTC_102
  gRNA
acggauugcugacgcuauca

SEQ ID NO: 139783 - RNA, 20 nt, Artificial Sequence
  mmSKRIPTE0010562_NTC_103
  gRNA
acgggucaacuucuugccgc

SEQ ID NO: 139784 - RNA, 20 nt, Artificial Sequence
  mmSKRIPTE0010563_NTC_104
  gRNA
acggucccaacgagcgccgg

SEQ ID NO: 139785 - RNA, 20 nt, Artificial Sequence
  mmSKRIPTE0010564_NTC_105
  gRNA
acggucccucucgggucaau

SEQ ID NO: 139786 - RNA, 20 nt, Artificial Sequence
  mmSKRIPTE0010565_NTC_106
  gRNA
acggucgagcacgguuauga

SEQ ID NO: 139787 - RNA, 20 nt, Artificial Sequence
  mmSKRIPTE0010566_NTC_107
  gRNA
acgucgaugcuuauccgucu

SEQ ID NO: 139788 - RNA, 20 nt, Artificial Sequence
  mmSKRIPTE0010567_NTC_108
  gRNA
acgucggucuagaguuaagu

SEQ ID NO: 139789 - RNA, 20 nt, Artificial Sequence
  mmSKRIPTE0010568_NTC_109
  gRNA
acguguaaggcgaacgccuu

SEQ ID NO: 139790 - RNA, 20 nt, Artificial Sequence
  mmSKRIPTE0010569_NTC_110
  gRNA
acguguucucguacuuagcu

SEQ ID NO: 139791 - RNA, 20 nt, Artificial Sequence
  mmSKRIPTE0010570_NTC_111
  gRNA
acguugcagcucgcguuucg

SEQ ID NO: 139792 - RNA, 20 nt, Artificial Sequence
  mmSKRIPTE0010571_NTC_112
  gRNA
acuaaggagucccgguccga

SEQ ID NO: 139793 - RNA, 20 nt, Artificial Sequence
  mmSKRIPTE0010572_NTC_113
  gRNA
acuagcuccauaacguguac

SEQ ID NO: 139794 - RNA, 20 nt, Artificial Sequence
  mmSKRIPTE0010573_NTC_114
  gRNA
acucaccucgcacgaucgua

SEQ ID NO: 139795 - RNA, 20 nt, Artificial Sequence
  mmSKRIPTE0010574_NTC_115
  gRNA
acucgaccuaacgucgaugu

SEQ ID NO: 139796 - RNA, 20 nt, Artificial Sequence
  mmSKRIPTE0010575_NTC_116
  gRNA
acucgcgaaaccguacauga

SEQ ID NO: 139797 - RNA, 20 nt, Artificial Sequence
  mmSKRIPTE0010576_NTC_117
  gRNA
acugcgcguauaggacgcaa

SEQ ID NO: 139798 - RNA, 20 nt, Artificial Sequence
  mmSKRIPTE0010577_NTC_118
  gRNA
acugucccauuguacgacgg

SEQ ID NO: 139799 - RNA, 20 nt, Artificial Sequence
  mmSKRIPTE0010578_NTC_119
  gRNA
acuucccgcgguuccguuga

SEQ ID NO: 139800 - RNA, 20 nt, Artificial Sequence
  mmSKRIPTE0010579_NTC_120
  gRNA
acuuguauacgacggcuaga

SEQ ID NO: 139801 - RNA, 20 nt, Artificial Sequence
  mmSKRIPTE0010580_NTC_121
  gRNA
acuuuacaucaugucgucgu

SEQ ID NO: 139802 - RNA, 20 nt, Artificial Sequence
  mmSKRIPTE0010581_NTC_122
  gRNA
agaaaggcacgugcgacguc

SEQ ID NO: 139803 - RNA, 20 nt, Artificial Sequence
  mmSKRIPTE0010582_NTC_123
  gRNA
agaaauccagucccgccuaa

SEQ ID NO: 139804 - RNA, 20 nt, Artificial Sequence
  mmSKRIPTE0010583_NTC_124
  gRNA
agaccucguuagccguagcu

SEQ ID NO: 139805 - RNA, 20 nt, Artificial Sequence
  mmSKRIPTE0010584_NTC_125
  gRNA
agacguugauuuaccggcca

SEQ ID NO: 139806 - RNA, 20 nt, Artificial Sequence
  mmSKRIPTE0010585_NTC_126
  gRNA
agacucgugugccacgagga

SEQ ID NO: 139807 - RNA, 20 nt, Artificial Sequence
  mmSKRIPTE0010586_NTC_127
  gRNA
agaggcggagcaauacucgc

SEQ ID NO: 139808 - RNA, 20 nt, Artificial Sequence
  mmSKRIPTE0010587_NTC_128
  gRNA
agauagcgcaaucccgcaug

SEQ ID NO: 139809 - RNA, 20 nt, Artificial Sequence
  mmSKRIPTE0010588_NTC_129
  gRNA
agauucucgcguaaccagag

SEQ ID NO: 139810 - RNA, 20 nt, Artificial Sequence
  mmSKRIPTE0010589_NTC_130
  gRNA
agcacgcgcacaagagccgc

SEQ ID NO: 139811 - RNA, 20 nt, Artificial Sequence
  mmSKRIPTE0010590_NTC_131
  gRNA
agcacuaggaucgcggccuu

SEQ ID NO: 139812 - RNA, 20 nt, Artificial Sequence
  mmSKRIPTE0010591_NTC_132
  gRNA
agcaguucggguaacgccca

SEQ ID NO: 139813 - RNA, 20 nt, Artificial Sequence
  mmSKRIPTE0010592_NTC_133
  gRNA
agcauggagucaacguccgc

SEQ ID NO: 139814 - RNA, 20 nt, Artificial Sequence
  mmSKRIPTE0010593_NTC_134
  gRNA
agccgcgccgcaaagcuuuu

SEQ ID NO: 139815 - RNA, 20 nt, Artificial Sequence
  mmSKRIPTE0010594_NTC_135
  gRNA
agccgggcuuuccgucaagc

SEQ ID NO: 139816 - RNA, 20 nt, Artificial Sequence
  mmSKRIPTE0010595_NTC_136
  gRNA
agccuagucgcgcuaauauu

SEQ ID NO: 139817 - RNA, 20 nt, Artificial Sequence
  mmSKRIPTE0010596_NTC_137
  gRNA
agcgaguguccgugacguuc

SEQ ID NO: 139818 - RNA, 20 nt, Artificial Sequence
  mmSKRIPTE0010597_NTC_138
  gRNA
agcgauguucacgcacagcg

SEQ ID NO: 139819 - RNA, 20 nt, Artificial Sequence
  mmSKRIPTE0010598_NTC_139
  gRNA
agcgccauaggacgccaaac

SEQ ID NO: 139820 - RNA, 20 nt, Artificial Sequence
  mmSKRIPTE0010599_NTC_140
  gRNA
agcgcguaaggcguaguuac

SEQ ID NO: 139821 - RNA, 20 nt, Artificial Sequence
  mmSKRIPTE0010600_NTC_141
  gRNA
agcguaucuuauguaccgcu

SEQ ID NO: 139822 - RNA, 20 nt, Artificial Sequence
  mmSKRIPTE0010601_NTC_142
  gRNA
agcguccacgcgucuaugga

SEQ ID NO: 139823 - RNA, 20 nt, Artificial Sequence
  mmSKRIPTE0010602_NTC_143
  gRNA
agcgugucgagaacggcuug

SEQ ID NO: 139824 - RNA, 20 nt, Artificial Sequence
  mmSKRIPTE0010603_NTC_144
  gRNA
agcguucgcagcuggucaac

SEQ ID NO: 139825 - RNA, 20 nt, Artificial Sequence
  mmSKRIPTE0010604_NTC_145
  gRNA
agcuauccccacguucgcgg

SEQ ID NO: 139826 - RNA, 20 nt, Artificial Sequence
  mmSKRIPTE0010605_NTC_146
  gRNA
agcuuagaucgugcgucgua

SEQ ID NO: 139827 - RNA, 20 nt, Artificial Sequence
  mmSKRIPTE0010606_NTC_147
  gRNA
aggacuauccgcgggauuag

SEQ ID NO: 139828 - RNA, 20 nt, Artificial Sequence
  mmSKRIPTE0010607_NTC_148
  gRNA
aggcagcccgcguuagagau

SEQ ID NO: 139829 - RNA, 20 nt, Artificial Sequence
  mmSKRIPTE0010608_NTC_149
  gRNA
aggccccgagacgcgccaca

SEQ ID NO: 139830 - RNA, 20 nt, Artificial Sequence
  mmSKRIPTE0010609_NTC_150
  gRNA
agggcaaucgcgugcccaac

SEQ ID NO: 139831 - RNA, 20 nt, Artificial Sequence
  mmSKRIPTE0010610_NTC_151
  gRNA
aggguuaggcugacccgcga

SEQ ID NO: 139832 - RNA, 20 nt, Artificial Sequence
  mmSKRIPTE0010611_NTC_152
  gRNA
agguccgcuggcgcaauggg

SEQ ID NO: 139833 - RNA, 20 nt, Artificial Sequence
  mmSKRIPTE0010612_NTC_153
  gRNA
aggucguggacccgcaugua

SEQ ID NO: 139834 - RNA, 20 nt, Artificial Sequence
  mmSKRIPTE0010613_NTC_154
  gRNA
aggugcgugucaaccgguag

SEQ ID NO: 139835 - RNA, 20 nt, Artificial Sequence
  mmSKRIPTE0010614_NTC_155
  gRNA
aguacacuacaucgacuucg

SEQ ID NO: 139836 - RNA, 20 nt, Artificial Sequence
  mmSKRIPTE0010615_NTC_156
  gRNA
aguacagccgacgagugcga

SEQ ID NO: 139837 - RNA, 20 nt, Artificial Sequence
  mmSKRIPTE0010616_NTC_157
  gRNA
aguagacgcuauguucgcgc

SEQ ID NO: 139838 - RNA, 20 nt, Artificial Sequence
  mmSKRIPTE0010617_NTC_158
  gRNA
aguagagucgcgaacgcuac

SEQ ID NO: 139839 - RNA, 20 nt, Artificial Sequence
  mmSKRIPTE0010618_NTC_159
  gRNA
agucacuaggcgcucucgcg

SEQ ID NO: 139840 - RNA, 20 nt, Artificial Sequence
  mmSKRIPTE0010619_NTC_160
  gRNA
agucagcuccgggguauacg

SEQ ID NO: 139841 - RNA, 20 nt, Artificial Sequence
  mmSKRIPTE0010620_NTC_161
  gRNA
agucauccucuaugcgcgua

SEQ ID NO: 139842 - RNA, 20 nt, Artificial Sequence
  mmSKRIPTE0010621_NTC_162
  gRNA
agucccacguuugccgucaa

SEQ ID NO: 139843 - RNA, 20 nt, Artificial Sequence
  mmSKRIPTE0010622_NTC_163
  gRNA
aguccggucgaaaucuguau

SEQ ID NO: 139844 - RNA, 20 nt, Artificial Sequence
  mmSKRIPTE0010623_NTC_164
  gRNA
agugccggggguguauaccg

SEQ ID NO: 139845 - RNA, 20 nt, Artificial Sequence
  mmSKRIPTE0010624_NTC_165
  gRNA
agugucacggcaaagucgag

SEQ ID NO: 139846 - RNA, 20 nt, Artificial Sequence
  mmSKRIPTE0010625_NTC_166
  gRNA
aguuaagcgcguaucuacgu

SEQ ID NO: 139847 - RNA, 20 nt, Artificial Sequence
  mmSKRIPTE0010626_NTC_167
  gRNA
aguuaagcuccaaucgucug

SEQ ID NO: 139848 - RNA, 20 nt, Artificial Sequence
  mmSKRIPTE0010627_NTC_168
  gRNA
aguuuacgugguccgauguc

SEQ ID NO: 139849 - RNA, 20 nt, Artificial Sequence
  mmSKRIPTE0010628_NTC_169
  gRNA
auaaagucccaggugcgcgc

SEQ ID NO: 139850 - RNA, 20 nt, Artificial Sequence
  mmSKRIPTE0010629_NTC_170
  gRNA
auaacuuacucguuacgacu

SEQ ID NO: 139851 - RNA, 20 nt, Artificial Sequence
  mmSKRIPTE0010630_NTC_171
  gRNA
auaacuuaugcgcuucgggg

SEQ ID NO: 139852 - RNA, 20 nt, Artificial Sequence
  mmSKRIPTE0010631_NTC_172
  gRNA
auaaugcgcgcgaauacuua

SEQ ID NO: 139853 - RNA, 20 nt, Artificial Sequence
  mmSKRIPTE0010632_NTC_173
  gRNA
auaccuccgcuacaccgucu

SEQ ID NO: 139854 - RNA, 20 nt, Artificial Sequence
  mmSKRIPTE0010633_NTC_174
  gRNA
auacgcauagaucgguaagc

SEQ ID NO: 139855 - RNA, 20 nt, Artificial Sequence
  mmSKRIPTE0010634_NTC_175
  gRNA
auacgcgugaugaccuuaug

SEQ ID NO: 139856 - RNA, 20 nt, Artificial Sequence
  mmSKRIPTE0010635_NTC_176
  gRNA
auagaugucuacgcgccguu

SEQ ID NO: 139857 - RNA, 20 nt, Artificial Sequence
  mmSKRIPTE0010636_NTC_177
  gRNA
auagcccgguuugcccgucu

SEQ ID NO: 139858 - RNA, 20 nt, Artificial Sequence
  mmSKRIPTE0010637_NTC_178
  gRNA
auaggcgcacgggcuacucc

SEQ ID NO: 139859 - RNA, 20 nt, Artificial Sequence
  mmSKRIPTE0010638_NTC_179
  gRNA
auaucgaaugauguccgcau

SEQ ID NO: 139860 - RNA, 20 nt, Artificial Sequence
  mmSKRIPTE0010639_NTC_180
  gRNA
auaugagcccgaccucucga

SEQ ID NO: 139861 - RNA, 20 nt, Artificial Sequence
  mmSKRIPTE0010640_NTC_181
  gRNA
auaugcucgacccaucgucc

SEQ ID NO: 139862 - RNA, 20 nt, Artificial Sequence
  mmSKRIPTE0010641_NTC_182
  gRNA
auauugucccauacgaucgg

SEQ ID NO: 139863 - RNA, 20 nt, Artificial Sequence
  mmSKRIPTE0010642_NTC_183
  gRNA
aucacacguuaaacggggcg

SEQ ID NO: 139864 - RNA, 20 nt, Artificial Sequence
  mmSKRIPTE0010643_NTC_184
  gRNA
aucaugccuucgcauuaacc

SEQ ID NO: 139865 - RNA, 20 nt, Artificial Sequence
  mmSKRIPTE0010644_NTC_185
  gRNA
auccacgcuccgcgguacuu

SEQ ID NO: 139866 - RNA, 20 nt, Artificial Sequence
  mmSKRIPTE0010645_NTC_186
  gRNA
auccccccgacuuagggauu

SEQ ID NO: 139867 - RNA, 20 nt, Artificial Sequence
  mmSKRIPTE0010646_NTC_187
  gRNA
auccgagaucugcgaauuau

SEQ ID NO: 139868 - RNA, 20 nt, Artificial Sequence
  mmSKRIPTE0010647_NTC_188
  gRNA
auccgggcauagcguuuaaa

SEQ ID NO: 139869 - RNA, 20 nt, Artificial Sequence
  mmSKRIPTE0010648_NTC_189
  gRNA
auccguaccaaacacgcuac

SEQ ID NO: 139870 - RNA, 20 nt, Artificial Sequence
  mmSKRIPTE0010649_NTC_190
  gRNA
aucgagcaccgaguugugau

SEQ ID NO: 139871 - RNA, 20 nt, Artificial Sequence
  mmSKRIPTE0010650_NTC_191
  gRNA
aucgauauugauaaacgcga

SEQ ID NO: 139872 - RNA, 20 nt, Artificial Sequence
  mmSKRIPTE0010651_NTC_192
  gRNA
aucgcaggucuacgcagagu

SEQ ID NO: 139873 - RNA, 20 nt, Artificial Sequence
  mmSKRIPTE0010652_NTC_193
  gRNA
aucgccuagcccaagcgacg

SEQ ID NO: 139874 - RNA, 20 nt, Artificial Sequence
  mmSKRIPTE0010653_NTC_194
  gRNA
aucgcggcgcguuaaggcag

SEQ ID NO: 139875 - RNA, 20 nt, Artificial Sequence
  mmSKRIPTE0010654_NTC_195
  gRNA
aucgcuaauuuacgaaggcg

SEQ ID NO: 139876 - RNA, 20 nt, Artificial Sequence
  mmSKRIPTE0010655_NTC_196
  gRNA
aucguaaauuacacguacag

SEQ ID NO: 139877 - RNA, 20 nt, Artificial Sequence
  mmSKRIPTE0010656_NTC_197
  gRNA
aucuuaaccagcgcaucccg

SEQ ID NO: 139878 - RNA, 20 nt, Artificial Sequence
  mmSKRIPTE0010657_NTC_198
  gRNA
augacacuuacgguacucgu

SEQ ID NO: 139879 - RNA, 20 nt, Artificial Sequence
  mmSKRIPTE0010658_NTC_199
  gRNA
augaccucuucguucgagag

SEQ ID NO: 139880 - RNA, 20 nt, Artificial Sequence
  mmSKRIPTE0010659_NTC_200
  gRNA
augaugugauccuucgccga

SEQ ID NO: 139881 - RNA, 20 nt, Artificial Sequence
  mmSKRIPTE0010660_NTC_201
  gRNA
augccaaugccguuguuagc

SEQ ID NO: 139882 - RNA, 20 nt, Artificial Sequence
  mmSKRIPTE0010661_NTC_202
  gRNA
auggacccuucagugcggua

SEQ ID NO: 139883 - RNA, 20 nt, Artificial Sequence
  mmSKRIPTE0010662_NTC_203
  gRNA
augggaaagcccacgacaau

SEQ ID NO: 139884 - RNA, 20 nt, Artificial Sequence
  mmSKRIPTE0010663_NTC_204
  gRNA
augguggcuguacucguaac

SEQ ID NO: 139885 - RNA, 20 nt, Artificial Sequence
  mmSKRIPTE0010664_NTC_205
  gRNA
auguguaugaagcccgucau

SEQ ID NO: 139886 - RNA, 20 nt, Artificial Sequence
  mmSKRIPTE0010665_NTC_206
  gRNA
augugucauagcggcguagg

SEQ ID NO: 139887 - RNA, 20 nt, Artificial Sequence
  mmSKRIPTE0010666_NTC_207
  gRNA
auguuacguacgugaucucc

SEQ ID NO: 139888 - RNA, 20 nt, Artificial Sequence
  mmSKRIPTE0010667_NTC_208
  gRNA
auguugcagcgcuguacgcc

SEQ ID NO: 139889 - RNA, 20 nt, Artificial Sequence
  mmSKRIPTE0010668_NTC_209
  gRNA
auguugcaguucggcucgau

SEQ ID NO: 139890 - RNA, 20 nt, Artificial Sequence
  mmSKRIPTE0010669_NTC_210
  gRNA
auuaggugacuggaacacgu

SEQ ID NO: 139891 - RNA, 20 nt, Artificial Sequence
  mmSKRIPTE0010670_NTC_211
  gRNA
auuauagcagccccccgaau

SEQ ID NO: 139892 - RNA, 20 nt, Artificial Sequence
  mmSKRIPTE0010671_NTC_212
  gRNA
auuauuccuccggaugacga

SEQ ID NO: 139893 - RNA, 20 nt, Artificial Sequence
  mmSKRIPTE0010672_NTC_213
  gRNA
auucaguguaccggucaaau

SEQ ID NO: 139894 - RNA, 20 nt, Artificial Sequence
  mmSKRIPTE0010673_NTC_214
  gRNA
auuccguuugcagcgagacc

SEQ ID NO: 139895 - RNA, 20 nt, Artificial Sequence
  mmSKRIPTE0010674_NTC_215
  gRNA
auucggaccguuaucucacc

SEQ ID NO: 139896 - RNA, 20 nt, Artificial Sequence
  mmSKRIPTE0010675_NTC_216
  gRNA
auucgugcaucgcgggguuu

SEQ ID NO: 139897 - RNA, 20 nt, Artificial Sequence
  mmSKRIPTE0010676_NTC_217
  gRNA
auuguucgaccgucuacggg

SEQ ID NO: 139898 - RNA, 20 nt, Artificial Sequence
  mmSKRIPTE0010677_NTC_218
  gRNA
auuugaaugcucccgucgac

SEQ ID NO: 139899 - RNA, 20 nt, Artificial Sequence
  mmSKRIPTE0010678_NTC_219
  gRNA
auuugcccguccauacgcgg

SEQ ID NO: 139900 - RNA, 20 nt, Artificial Sequence
  mmSKRIPTE0010679_NTC_220
  gRNA
caaacgaggccacguacgug

SEQ ID NO: 139901 - RNA, 20 nt, Artificial Sequence
  mmSKRIPTE0010680_NTC_221
  gRNA
caaaguaacuaucucgucga

SEQ ID NO: 139902 - RNA, 20 nt, Artificial Sequence
  mmSKRIPTE0010681_NTC_222
  gRNA
caacacgugcgagcgaacug

SEQ ID NO: 139903 - RNA, 20 nt, Artificial Sequence
  mmSKRIPTE0010682_NTC_223
  gRNA
caaccgugcgaugcgcgcua

SEQ ID NO: 139904 - RNA, 20 nt, Artificial Sequence
  mmSKRIPTE0010683_NTC_224
  gRNA
caaccugccuagcgacccgc

SEQ ID NO: 139905 - RNA, 20 nt, Artificial Sequence
  mmSKRIPTE0010684_NTC_225
  gRNA
caacgaucaggcguguuauc

SEQ ID NO: 139906 - RNA, 20 nt, Artificial Sequence
  mmSKRIPTE0010685_NTC_226
  gRNA
caacggucacgcuagaauaa

SEQ ID NO: 139907 - RNA, 20 nt, Artificial Sequence
  mmSKRIPTE0010686_NTC_227
  gRNA
caagaguuaaccucgaccgg

SEQ ID NO: 139908 - RNA, 20 nt, Artificial Sequence
  mmSKRIPTE0010687_NTC_228
  gRNA
caaggaucgugccgugauuu

SEQ ID NO: 139909 - RNA, 20 nt, Artificial Sequence
  mmSKRIPTE0010688_NTC_229
  gRNA
caagggguggucauugcgac

SEQ ID NO: 139910 - RNA, 20 nt, Artificial Sequence
  mmSKRIPTE0010689_NTC_230
  gRNA
caauacaccguuaacccucu

SEQ ID NO: 139911 - RNA, 20 nt, Artificial Sequence
  mmSKRIPTE0010690_NTC_231
  gRNA
caauaucuaagcgcuaacga

SEQ ID NO: 139912 - RNA, 20 nt, Artificial Sequence
  mmSKRIPTE0010691_NTC_232
  gRNA
caauaugcacguagccucgu

SEQ ID NO: 139913 - RNA, 20 nt, Artificial Sequence
  mmSKRIPTE0010692_NTC_233
  gRNA
caauauucgaccuacgcucc

SEQ ID NO: 139914 - RNA, 20 nt, Artificial Sequence
  mmSKRIPTE0010693_NTC_234
  gRNA
caauggcgucugccguucag

SEQ ID NO: 139915 - RNA, 20 nt, Artificial Sequence
  mmSKRIPTE0010694_NTC_235
  gRNA
cacaacgccuaccagcggac

SEQ ID NO: 139916 - RNA, 20 nt, Artificial Sequence
  mmSKRIPTE0010695_NTC_236
  gRNA
cacaauacgcggcagagguc

SEQ ID NO: 139917 - RNA, 20 nt, Artificial Sequence
  mmSKRIPTE0010696_NTC_237
  gRNA
cacacgccgcgggccgugag

SEQ ID NO: 139918 - RNA, 20 nt, Artificial Sequence
  mmSKRIPTE0010697_NTC_238
  gRNA
caccccguagcaacgauaaa

SEQ ID NO: 139919 - RNA, 20 nt, Artificial Sequence
  mmSKRIPTE0010698_NTC_239
  gRNA
cacccgacucggccguaaag

SEQ ID NO: 139920 - RNA, 20 nt, Artificial Sequence
  mmSKRIPTE0010699_NTC_240
  gRNA
caccgcugcccuaguaccgg

SEQ ID NO: 139921 - RNA, 20 nt, Artificial Sequence
  mmSKRIPTE0010700_NTC_241
  gRNA
caccuauuccccuccgcaac

SEQ ID NO: 139922 - RNA, 20 nt, Artificial Sequence
  mmSKRIPTE0010701_NTC_242
  gRNA
caccucgcgucauaucacua

SEQ ID NO: 139923 - RNA, 20 nt, Artificial Sequence
  mmSKRIPTE0010702_NTC_243
  gRNA
caccuuucgagguaacaccg

SEQ ID NO: 139924 - RNA, 20 nt, Artificial Sequence
  mmSKRIPTE0010703_NTC_244
  gRNA
cacgaauaacuacagguugc

SEQ ID NO: 139925 - RNA, 20 nt, Artificial Sequence
  mmSKRIPTE0010704_NTC_245
  gRNA
cacgcaggagcggcgacacu

SEQ ID NO: 139926 - RNA, 20 nt, Artificial Sequence
  mmSKRIPTE0010705_NTC_246
  gRNA
cacgccuucgucaacccuau

SEQ ID NO: 139927 - RNA, 20 nt, Artificial Sequence
  mmSKRIPTE0010706_NTC_247
  gRNA
cacggcaggcaucucgucua

SEQ ID NO: 139928 - RNA, 20 nt, Artificial Sequence
  mmSKRIPTE0010707_NTC_248
  gRNA
cacgggcagcgaucuaguug

SEQ ID NO: 139929 - RNA, 20 nt, Artificial Sequence
  mmSKRIPTE0010708_NTC_249
  gRNA
cacguaagacgcuccacuua

SEQ ID NO: 139930 - RNA, 20 nt, Artificial Sequence
  mmSKRIPTE0010709_NTC_250
  gRNA
cacguauacuuaggucagcg

SEQ ID NO: 139931 - RNA, 20 nt, Artificial Sequence
  mmSKRIPTE0010710_NTC_251
  gRNA
cacucagcgguuggacgccc

SEQ ID NO: 139932 - RNA, 20 nt, Artificial Sequence
  mmSKRIPTE0010711_NTC_252
  gRNA
cagaaacucuuaccgagcgc

SEQ ID NO: 139933 - RNA, 20 nt, Artificial Sequence
  mmSKRIPTE0010712_NTC_253
  gRNA
cagcaccacgcgucgugcgg

SEQ ID NO: 139934 - RNA, 20 nt, Artificial Sequence
  mmSKRIPTE0010713_NTC_254
  gRNA
cagccaccgcaccggcguaa

SEQ ID NO: 139935 - RNA, 20 nt, Artificial Sequence
  mmSKRIPTE0010714_NTC_255
  gRNA
cagcgacucugaucggcgua

SEQ ID NO: 139936 - RNA, 20 nt, Artificial Sequence
  mmSKRIPTE0010715_NTC_256
  gRNA
cagcucacccugcguacggu

SEQ ID NO: 139937 - RNA, 20 nt, Artificial Sequence
  mmSKRIPTE0010716_NTC_257
  gRNA
cagcugaccguuaaucgaua

SEQ ID NO: 139938 - RNA, 20 nt, Artificial Sequence
  mmSKRIPTE0010717_NTC_258
  gRNA
cagggacguagccgccguua

SEQ ID NO: 139939 - RNA, 20 nt, Artificial Sequence
  mmSKRIPTE0010718_NTC_259
  gRNA
cagguuuccccuagucgaau

SEQ ID NO: 139940 - RNA, 20 nt, Artificial Sequence
  mmSKRIPTE0010719_NTC_260
  gRNA
cagugccgguagcggcacgg

SEQ ID NO: 139941 - RNA, 20 nt, Artificial Sequence
  mmSKRIPTE0010720_NTC_261
  gRNA
cauacccgcgccgugacucc

SEQ ID NO: 139942 - RNA, 20 nt, Artificial Sequence
  mmSKRIPTE0010721_NTC_262
  gRNA
cauacccgguguuuccuagc

SEQ ID NO: 139943 - RNA, 20 nt, Artificial Sequence
  mmSKRIPTE0010722_NTC_263
  gRNA
cauacuguuaucgacccgca

SEQ ID NO: 139944 - RNA, 20 nt, Artificial Sequence
  mmSKRIPTE0010723_NTC_264
  gRNA
cauagauccgcgauuguacg

SEQ ID NO: 139945 - RNA, 20 nt, Artificial Sequence
  mmSKRIPTE0010724_NTC_265
  gRNA
cauagcaacgcccaaacucg

SEQ ID NO: 139946 - RNA, 20 nt, Artificial Sequence
  mmSKRIPTE0010725_NTC_266
  gRNA
cauauacucuugcgcuagac

SEQ ID NO: 139947 - RNA, 20 nt, Artificial Sequence
  mmSKRIPTE0010726_NTC_267
  gRNA
cauaugccuauaaccggcgg

SEQ ID NO: 139948 - RNA, 20 nt, Artificial Sequence
  mmSKRIPTE0010727_NTC_268
  gRNA
cauaugcucgacgguauaaa

SEQ ID NO: 139949 - RNA, 20 nt, Artificial Sequence
  mmSKRIPTE0010728_NTC_269
  gRNA
caucagcccauuaugacucg

SEQ ID NO: 139950 - RNA, 20 nt, Artificial Sequence
  mmSKRIPTE0010729_NTC_270
  gRNA
caucccccgacuacgacuac

SEQ ID NO: 139951 - RNA, 20 nt, Artificial Sequence
  mmSKRIPTE0010730_NTC_271
  gRNA
caucgaggguaaacgccauu

SEQ ID NO: 139952 - RNA, 20 nt, Artificial Sequence
  mmSKRIPTE0010731_NTC_272
  gRNA
caucgccgacgauccucugg

SEQ ID NO: 139953 - RNA, 20 nt, Artificial Sequence
  mmSKRIPTE0010732_NTC_273
  gRNA
caucggcuaugucggggaca

SEQ ID NO: 139954 - RNA, 20 nt, Artificial Sequence
  mmSKRIPTE0010733_NTC_274
  gRNA
caucgguagucacuacgccc

SEQ ID NO: 139955 - RNA, 20 nt, Artificial Sequence
  mmSKRIPTE0010734_NTC_275
  gRNA
caucguaacacacguacgag

SEQ ID NO: 139956 - RNA, 20 nt, Artificial Sequence
  mmSKRIPTE0010735_NTC_276
  gRNA
caucuaugagacgugcguac

SEQ ID NO: 139957 - RNA, 20 nt, Artificial Sequence
  mmSKRIPTE0010736_NTC_277
  gRNA
caugcccgucugcgccgcau

SEQ ID NO: 139958 - RNA, 20 nt, Artificial Sequence
  mmSKRIPTE0010737_NTC_278
  gRNA
caugggacccccccucacgu

SEQ ID NO: 139959 - RNA, 20 nt, Artificial Sequence
  mmSKRIPTE0010738_NTC_279
  gRNA
cauuacgugucgagcuccgg

SEQ ID NO: 139960 - RNA, 20 nt, Artificial Sequence
  mmSKRIPTE0010739_NTC_280
  gRNA
cauucgguccguucaucucg

SEQ ID NO: 139961 - RNA, 20 nt, Artificial Sequence
  mmSKRIPTE0010740_NTC_281
  gRNA
cauucucugacgaaugcgcc

SEQ ID NO: 139962 - RNA, 20 nt, Artificial Sequence
  mmSKRIPTE0010741_NTC_282
  gRNA
cauuguagacucguacggau

SEQ ID NO: 139963 - RNA, 20 nt, Artificial Sequence
  mmSKRIPTE0010742_NTC_283
  gRNA
cauuuccgggguccgaugca

SEQ ID NO: 139964 - RNA, 20 nt, Artificial Sequence
  mmSKRIPTE0010743_NTC_284
  gRNA
ccaacaucggggcgcauaau

SEQ ID NO: 139965 - RNA, 20 nt, Artificial Sequence
  mmSKRIPTE0010744_NTC_285
  gRNA
ccaacccggcaucguccgcu

SEQ ID NO: 139966 - RNA, 20 nt, Artificial Sequence
  mmSKRIPTE0010745_NTC_286
  gRNA
ccaaccuaaggcaauacggu

SEQ ID NO: 139967 - RNA, 20 nt, Artificial Sequence
  mmSKRIPTE0010746_NTC_287
  gRNA
ccaaggcgcacgcuacgugg

SEQ ID NO: 139968 - RNA, 20 nt, Artificial Sequence
  mmSKRIPTE0010747_NTC_288
  gRNA
ccagcggacggcgaacucca

SEQ ID NO: 139969 - RNA, 20 nt, Artificial Sequence
  mmSKRIPTE0010748_NTC_289
  gRNA
ccagcuaacguuuuaguacg

SEQ ID NO: 139970 - RNA, 20 nt, Artificial Sequence
  mmSKRIPTE0010749_NTC_290
  gRNA
ccaucgguucgacuuaccgc

SEQ ID NO: 139971 - RNA, 20 nt, Artificial Sequence
  mmSKRIPTE0010750_NTC_291
  gRNA
ccauuaguacgaacauugcg

SEQ ID NO: 139972 - RNA, 20 nt, Artificial Sequence
  mmSKRIPTE0010751_NTC_292
  gRNA
cccacuuaauaacgccgcuu

SEQ ID NO: 139973 - RNA, 20 nt, Artificial Sequence
  mmSKRIPTE0010752_NTC_293
  gRNA
cccaucauucgcgcugacgu

SEQ ID NO: 139974 - RNA, 20 nt, Artificial Sequence
  mmSKRIPTE0010753_NTC_294
  gRNA
cccauucaacaccguuugua

SEQ ID NO: 139975 - RNA, 20 nt, Artificial Sequence
  mmSKRIPTE0010754_NTC_295
  gRNA
ccccuauaggcgcgcuaagg

SEQ ID NO: 139976 - RNA, 20 nt, Artificial Sequence
  mmSKRIPTE0010755_NTC_296
  gRNA
ccccuucgauauccgaugac

SEQ ID NO: 139977 - RNA, 20 nt, Artificial Sequence
  mmSKRIPTE0010756_NTC_297
  gRNA
cccgccuggcgauucacggg

SEQ ID NO: 139978 - RNA, 20 nt, Artificial Sequence
  mmSKRIPTE0010757_NTC_298
  gRNA
cccggcagacuaacuagcgc

SEQ ID NO: 139979 - RNA, 20 nt, Artificial Sequence
  mmSKRIPTE0010758_NTC_299
  gRNA
cccggguacaccaauagcca

SEQ ID NO: 139980 - RNA, 20 nt, Artificial Sequence
  mmSKRIPTE0010759_NTC_300
  gRNA
cccggucggggauacuaacu

SEQ ID NO: 139981 - RNA, 20 nt, Artificial Sequence
  mmSKRIPTE0010760_NTC_301
  gRNA
cccguaggggucgugguuuu

SEQ ID NO: 139982 - RNA, 20 nt, Artificial Sequence
  mmSKRIPTE0010761_NTC_302
  gRNA
cccuaaaccauaguuucgcc

SEQ ID NO: 139983 - RNA, 20 nt, Artificial Sequence
  mmSKRIPTE0010762_NTC_303
  gRNA
cccuagcucgguuagagaau

SEQ ID NO: 139984 - RNA, 20 nt, Artificial Sequence
  mmSKRIPTE0010763_NTC_304
  gRNA
cccuauaugcgagauccaua

SEQ ID NO: 139985 - RNA, 20 nt, Artificial Sequence
  mmSKRIPTE0010764_NTC_305
  gRNA
cccucgguugagcagcgcga

SEQ ID NO: 139986 - RNA, 20 nt, Artificial Sequence
  mmSKRIPTE0010765_NTC_306
  gRNA
cccugaugugcuauacgcgc

SEQ ID NO: 139987 - RNA, 20 nt, Artificial Sequence
  mmSKRIPTE0010766_NTC_307
  gRNA
cccuuaaagugacggacgaa

SEQ ID NO: 139988 - RNA, 20 nt, Artificial Sequence
  mmSKRIPTE0010767_NTC_308
  gRNA
ccgaccgugugagaguacgu

SEQ ID NO: 139989 - RNA, 20 nt, Artificial Sequence
  mmSKRIPTE0010768_NTC_309
  gRNA
ccgacugccgagcuaggcgu

SEQ ID NO: 139990 - RNA, 20 nt, Artificial Sequence
  mmSKRIPTE0010769_NTC_310
  gRNA
ccgagagguacuccaauucg

SEQ ID NO: 139991 - RNA, 20 nt, Artificial Sequence
  mmSKRIPTE0010770_NTC_311
  gRNA
ccgagauggcucggauagac

SEQ ID NO: 139992 - RNA, 20 nt, Artificial Sequence
  mmSKRIPTE0010771_NTC_312
  gRNA
ccgagcacccuauuuaucua

SEQ ID NO: 139993 - RNA, 20 nt, Artificial Sequence
  mmSKRIPTE0010772_NTC_313
  gRNA
ccgagccgaauugggcgugu

SEQ ID NO: 139994 - RNA, 20 nt, Artificial Sequence
  mmSKRIPTE0010773_NTC_314
  gRNA
ccgauaccauugucaccaau

SEQ ID NO: 139995 - RNA, 20 nt, Artificial Sequence
  mmSKRIPTE0010774_NTC_315
  gRNA
ccgcaccgcagucaugguaa

SEQ ID NO: 139996 - RNA, 20 nt, Artificial Sequence
  mmSKRIPTE0010775_NTC_316
  gRNA
ccgccccugcgaacugcguu

SEQ ID NO: 139997 - RNA, 20 nt, Artificial Sequence
  mmSKRIPTE0010776_NTC_317
  gRNA
ccgcccgggugugaguugag

SEQ ID NO: 139998 - RNA, 20 nt, Artificial Sequence
  mmSKRIPTE0010777_NTC_318
  gRNA
ccgcgcauuaacgaucagua

SEQ ID NO: 139999 - RNA, 20 nt, Artificial Sequence
  mmSKRIPTE0010778_NTC_319
  gRNA
ccgcgccguuagggaacgag

SEQ ID NO: 140000 - RNA, 20 nt, Artificial Sequence
  mmSKRIPTE0010779_NTC_320
  gRNA
ccgcgugacgcaaucccuug

SEQ ID NO: 140001 - RNA, 20 nt, Artificial Sequence
  mmSKRIPTE0010780_NTC_321
  gRNA
ccgcuugggcgcuauuaauu

SEQ ID NO: 140002 - RNA, 20 nt, Artificial Sequence
  mmSKRIPTE0010781_NTC_322
  gRNA
ccggacuuguuauacuugau

SEQ ID NO: 140003 - RNA, 20 nt, Artificial Sequence
  mmSKRIPTE0010782_NTC_323
  gRNA
ccggagcgcguugcaguucu

SEQ ID NO: 140004 - RNA, 20 nt, Artificial Sequence
  mmSKRIPTE0010783_NTC_324
  gRNA
ccggaucggcuacgcuacgg

SEQ ID NO: 140005 - RNA, 20 nt, Artificial Sequence
  mmSKRIPTE0010784_NTC_325
  gRNA
ccggcgcugcggucggcuug

SEQ ID NO: 140006 - RNA, 20 nt, Artificial Sequence
  mmSKRIPTE0010785_NTC_326
  gRNA
ccggcuugaauaccgugcgg

SEQ ID NO: 140007 - RNA, 20 nt, Artificial Sequence
  mmSKRIPTE0010786_NTC_327
  gRNA
ccgggcgccguauccccuac

SEQ ID NO: 140008 - RNA, 20 nt, Artificial Sequence
  mmSKRIPTE0010787_NTC_328
  gRNA
ccgguuuauaaauuacgugg

SEQ ID NO: 140009 - RNA, 20 nt, Artificial Sequence
  mmSKRIPTE0010788_NTC_329
  gRNA
ccguauacguaucuaugccg

SEQ ID NO: 140010 - RNA, 20 nt, Artificial Sequence
  mmSKRIPTE0010789_NTC_330
  gRNA
ccgucgagcaaucccgccaa

SEQ ID NO: 140011 - RNA, 20 nt, Artificial Sequence
  mmSKRIPTE0010790_NTC_331
  gRNA
ccgugauuucgguagcguac

SEQ ID NO: 140012 - RNA, 20 nt, Artificial Sequence
  mmSKRIPTE0010791_NTC_332
  gRNA
ccguucaauuaugcuggcgu

SEQ ID NO: 140013 - RNA, 20 nt, Artificial Sequence
  mmSKRIPTE0010792_NTC_333
  gRNA
ccguucugacgacgcuaaag

SEQ ID NO: 140014 - RNA, 20 nt, Artificial Sequence
  mmSKRIPTE0010793_NTC_334
  gRNA
ccguuucgccuauuggugcg

SEQ ID NO: 140015 - RNA, 20 nt, Artificial Sequence
  mmSKRIPTE0010794_NTC_335
  gRNA
ccuaacucgaagucucguca

SEQ ID NO: 140016 - RNA, 20 nt, Artificial Sequence
  mmSKRIPTE0010795_NTC_336
  gRNA
ccuacuaacgacgagucaaa

SEQ ID NO: 140017 - RNA, 20 nt, Artificial Sequence
  mmSKRIPTE0010796_NTC_337
  gRNA
ccuauuaguccgguuuaguc

SEQ ID NO: 140018 - RNA, 20 nt, Artificial Sequence
  mmSKRIPTE0010797_NTC_338
  gRNA
ccucaaauagcgaacgucaa

SEQ ID NO: 140019 - RNA, 20 nt, Artificial Sequence
  mmSKRIPTE0010798_NTC_339
  gRNA
ccuccaguagcgucauuaac

SEQ ID NO: 140020 - RNA, 20 nt, Artificial Sequence
  mmSKRIPTE0010799_NTC_340
  gRNA
ccuccuucaguucgaucugg

SEQ ID NO: 140021 - RNA, 20 nt, Artificial Sequence
  mmSKRIPTE0010800_NTC_341
  gRNA
ccugcuauucucgcaugcga

SEQ ID NO: 140022 - RNA, 20 nt, Artificial Sequence
  mmSKRIPTE0010801_NTC_342
  gRNA
ccuuacggcggagaacgagu

SEQ ID NO: 140023 - RNA, 20 nt, Artificial Sequence
  mmSKRIPTE0010802_NTC_343
  gRNA
ccuuagaccggguguaccuc

SEQ ID NO: 140024 - RNA, 20 nt, Artificial Sequence
  mmSKRIPTE0010803_NTC_344
  gRNA
ccuucggauucguaggcugg

SEQ ID NO: 140025 - RNA, 20 nt, Artificial Sequence
  mmSKRIPTE0010804_NTC_345
  gRNA
ccuuguggcgugccaaacga

SEQ ID NO: 140026 - RNA, 20 nt, Artificial Sequence
  mmSKRIPTE0010805_NTC_346
  gRNA
ccuuugaugggcgcguacuc

SEQ ID NO: 140027 - RNA, 20 nt, Artificial Sequence
  mmSKRIPTE0010806_NTC_347
  gRNA
cgaaaccauaccuccuucga

SEQ ID NO: 140028 - RNA, 20 nt, Artificial Sequence
  mmSKRIPTE0010807_NTC_348
  gRNA
cgaaaggcccgacugcgugg

SEQ ID NO: 140029 - RNA, 20 nt, Artificial Sequence
  mmSKRIPTE0010808_NTC_349
  gRNA
cgaacuucuaccguugugcg

SEQ ID NO: 140030 - RNA, 20 nt, Artificial Sequence
  mmSKRIPTE0010809_NTC_350
  gRNA
cgaaguacacgguucucucg

SEQ ID NO: 140031 - RNA, 20 nt, Artificial Sequence
  mmSKRIPTE0010810_NTC_351
  gRNA
cgaaucgggaaggcgcgugu

SEQ ID NO: 140032 - RNA, 20 nt, Artificial Sequence
  mmSKRIPTE0010811_NTC_352
  gRNA
cgaaugcacaggcucgcggu

SEQ ID NO: 140033 - RNA, 20 nt, Artificial Sequence
  mmSKRIPTE0010812_NTC_353
  gRNA
cgaaugcgccggagaauauu

SEQ ID NO: 140034 - RNA, 20 nt, Artificial Sequence
  mmSKRIPTE0010813_NTC_354
  gRNA
cgacacgauggucauacuac

SEQ ID NO: 140035 - RNA, 20 nt, Artificial Sequence
  mmSKRIPTE0010814_NTC_355
  gRNA
cgacacuugggcugacgcgc

SEQ ID NO: 140036 - RNA, 20 nt, Artificial Sequence
  mmSKRIPTE0010815_NTC_356
  gRNA
cgacgacccauuucgguuau

SEQ ID NO: 140037 - RNA, 20 nt, Artificial Sequence
  mmSKRIPTE0010816_NTC_357
  gRNA
cgacgaccuuggauuggcag

SEQ ID NO: 140038 - RNA, 20 nt, Artificial Sequence
  mmSKRIPTE0010817_NTC_358
  gRNA
cgacgguugugcugaggcuu

SEQ ID NO: 140039 - RNA, 20 nt, Artificial Sequence
  mmSKRIPTE0010818_NTC_359
  gRNA
cgacuauugccguccaucuc

SEQ ID NO: 140040 - RNA, 20 nt, Artificial Sequence
  mmSKRIPTE0010819_NTC_360
  gRNA
cgacuccgggaauauccguu

SEQ ID NO: 140041 - RNA, 20 nt, Artificial Sequence
  mmSKRIPTE0010820_NTC_361
  gRNA
cgacucgcuuaaccgugcag

SEQ ID NO: 140042 - RNA, 20 nt, Artificial Sequence
  mmSKRIPTE0010821_NTC_362
  gRNA
cgagacgaauccaucaugcg

SEQ ID NO: 140043 - RNA, 20 nt, Artificial Sequence
  mmSKRIPTE0010822_NTC_363
  gRNA
cgagagaaucguccgucaua

SEQ ID NO: 140044 - RNA, 20 nt, Artificial Sequence
  mmSKRIPTE0010823_NTC_364
  gRNA
cgagccucgucuuucauggg

SEQ ID NO: 140045 - RNA, 20 nt, Artificial Sequence
  mmSKRIPTE0010824_NTC_365
  gRNA
cgagcucggcaaauuugauu

SEQ ID NO: 140046 - RNA, 20 nt, Artificial Sequence
  mmSKRIPTE0010825_NTC_366
  gRNA
cgaggauguacauacguaaa

SEQ ID NO: 140047 - RNA, 20 nt, Artificial Sequence
  mmSKRIPTE0010826_NTC_367
  gRNA
cgaggcuuaacgccagauuc

SEQ ID NO: 140048 - RNA, 20 nt, Artificial Sequence
  mmSKRIPTE0010827_NTC_368
  gRNA
cgaguaauuauuugcggucg

SEQ ID NO: 140049 - RNA, 20 nt, Artificial Sequence
  mmSKRIPTE0010828_NTC_369
  gRNA
cgaguaucagcaugucgacg

SEQ ID NO: 140050 - RNA, 20 nt, Artificial Sequence
  mmSKRIPTE0010829_NTC_370
  gRNA
cgauacgcuauagaauaguc

SEQ ID NO: 140051 - RNA, 20 nt, Artificial Sequence
  mmSKRIPTE0010830_NTC_371
  gRNA
cgaugucgaaagucggucaa

SEQ ID NO: 140052 - RNA, 20 nt, Artificial Sequence
  mmSKRIPTE0010831_NTC_372
  gRNA
cgauugacguugggcucuca

SEQ ID NO: 140053 - RNA, 20 nt, Artificial Sequence
  mmSKRIPTE0010832_NTC_373
  gRNA
cgcacuucuaguagcugucg

SEQ ID NO: 140054 - RNA, 20 nt, Artificial Sequence
  mmSKRIPTE0010833_NTC_374
  gRNA
cgcagaguucaaauccgcgc

SEQ ID NO: 140055 - RNA, 20 nt, Artificial Sequence
  mmSKRIPTE0010834_NTC_375
  gRNA
cgcauaguguaccguugcgc

SEQ ID NO: 140056 - RNA, 20 nt, Artificial Sequence
  mmSKRIPTE0010835_NTC_376
  gRNA
cgccaaugguggccgacucg

SEQ ID NO: 140057 - RNA, 20 nt, Artificial Sequence
  mmSKRIPTE0010836_NTC_377
  gRNA
cgccaguauaccacauucgu

SEQ ID NO: 140058 - RNA, 20 nt, Artificial Sequence
  mmSKRIPTE0010837_NTC_378
  gRNA
cgccccuaguugucccgccc

SEQ ID NO: 140059 - RNA, 20 nt, Artificial Sequence
  mmSKRIPTE0010838_NTC_379
  gRNA
cgccggaugacugguggaua

SEQ ID NO: 140060 - RNA, 20 nt, Artificial Sequence
  mmSKRIPTE0010839_NTC_380
  gRNA
cgccuaguaucuucggggau

SEQ ID NO: 140061 - RNA, 20 nt, Artificial Sequence
  mmSKRIPTE0010840_NTC_381
  gRNA
cgcgacguacggcuggagca

SEQ ID NO: 140062 - RNA, 20 nt, Artificial Sequence
  mmSKRIPTE0010841_NTC_382
  gRNA
cgcgccgagggccucguuac

SEQ ID NO: 140063 - RNA, 20 nt, Artificial Sequence
  mmSKRIPTE0010842_NTC_383
  gRNA
cgcgccuacccuuuuaccgc

SEQ ID NO: 140064 - RNA, 20 nt, Artificial Sequence
  mmSKRIPTE0010843_NTC_384
  gRNA
cgcgcgacugcagcuaaucu

SEQ ID NO: 140065 - RNA, 20 nt, Artificial Sequence
  mmSKRIPTE0010844_NTC_385
  gRNA
cgcgcggauauuuaaacuuc

SEQ ID NO: 140066 - RNA, 20 nt, Artificial Sequence
  mmSKRIPTE0010845_NTC_386
  gRNA
cgcgcggaucuuccguacaa

SEQ ID NO: 140067 - RNA, 20 nt, Artificial Sequence
  mmSKRIPTE0010846_NTC_387
  gRNA
cgcguauaugucacacggca

SEQ ID NO: 140068 - RNA, 20 nt, Artificial Sequence
  mmSKRIPTE0010847_NTC_388
  gRNA
cgcuacaguaaucgcaacga

SEQ ID NO: 140069 - RNA, 20 nt, Artificial Sequence
  mmSKRIPTE0010848_NTC_389
  gRNA
cgcuccguauccucucauaa

SEQ ID NO: 140070 - RNA, 20 nt, Artificial Sequence
  mmSKRIPTE0010849_NTC_390
  gRNA
cgcucgguaaggucgauugg

SEQ ID NO: 140071 - RNA, 20 nt, Artificial Sequence
  mmSKRIPTE0010850_NTC_391
  gRNA
cgcucggugacguauacacg

SEQ ID NO: 140072 - RNA, 20 nt, Artificial Sequence
  mmSKRIPTE0010851_NTC_392
  gRNA
cgcuucauugcccgaacgcu

SEQ ID NO: 140073 - RNA, 20 nt, Artificial Sequence
  mmSKRIPTE0010852_NTC_393
  gRNA
cgcuucgucucucgcaaaca

SEQ ID NO: 140074 - RNA, 20 nt, Artificial Sequence
  mmSKRIPTE0010853_NTC_394
  gRNA
cggaauacgccaaaaccuau

SEQ ID NO: 140075 - RNA, 20 nt, Artificial Sequence
  mmSKRIPTE0010854_NTC_395
  gRNA
cggacuuaccgcagauuaua

SEQ ID NO: 140076 - RNA, 20 nt, Artificial Sequence
  mmSKRIPTE0010855_NTC_396
  gRNA
cggauccgguacggucaguu

SEQ ID NO: 140077 - RNA, 20 nt, Artificial Sequence
  mmSKRIPTE0010856_NTC_397
  gRNA
cggauccucccguacuaucc

SEQ ID NO: 140078 - RNA, 20 nt, Artificial Sequence
  mmSKRIPTE0010857_NTC_398
  gRNA
cggcaagcgcauuccuaugg

SEQ ID NO: 140079 - RNA, 20 nt, Artificial Sequence
  mmSKRIPTE0010858_NTC_399
  gRNA
cggcaauguguggcgaccgc

SEQ ID NO: 140080 - RNA, 20 nt, Artificial Sequence
  mmSKRIPTE0010859_NTC_400
  gRNA
cggccguagugacgaaugga

SEQ ID NO: 140081 - RNA, 20 nt, Artificial Sequence
  mmSKRIPTE0010860_NTC_401
  gRNA
cggcgauaacagcgacaucg

SEQ ID NO: 140082 - RNA, 20 nt, Artificial Sequence
  mmSKRIPTE0010861_NTC_402
  gRNA
cgggcaauaugaucguaggc

SEQ ID NO: 140083 - RNA, 20 nt, Artificial Sequence
  mmSKRIPTE0010862_NTC_403
  gRNA
cgggcacuaacccgauacac

SEQ ID NO: 140084 - RNA, 20 nt, Artificial Sequence
  mmSKRIPTE0010863_NTC_404
  gRNA
cgggcgguaagagcucuacg

SEQ ID NO: 140085 - RNA, 20 nt, Artificial Sequence
  mmSKRIPTE0010864_NTC_405
  gRNA
cgggcgucaccugcuaguaa

SEQ ID NO: 140086 - RNA, 20 nt, Artificial Sequence
  mmSKRIPTE0010865_NTC_406
  gRNA
cggggcguacauguguggcc

SEQ ID NO: 140087 - RNA, 20 nt, Artificial Sequence
  mmSKRIPTE0010866_NTC_407
  gRNA
cggguuauagauagucgucg

SEQ ID NO: 140088 - RNA, 20 nt, Artificial Sequence
  mmSKRIPTE0010867_NTC_408
  gRNA
cgguaagaugguuauaccgu

SEQ ID NO: 140089 - RNA, 20 nt, Artificial Sequence
  mmSKRIPTE0010868_NTC_409
  gRNA
cgguaaggucggucuccauc

SEQ ID NO: 140090 - RNA, 20 nt, Artificial Sequence
  mmSKRIPTE0010869_NTC_410
  gRNA
cgguaccacgccccaccucg

SEQ ID NO: 140091 - RNA, 20 nt, Artificial Sequence
  mmSKRIPTE0010870_NTC_411
  gRNA
cggucagucgucuucccgga

SEQ ID NO: 140092 - RNA, 20 nt, Artificial Sequence
  mmSKRIPTE0010871_NTC_412
  gRNA
cggucgauuguggaguaaug

SEQ ID NO: 140093 - RNA, 20 nt, Artificial Sequence
  mmSKRIPTE0010872_NTC_413
  gRNA
cggucgugacagaccuggug

SEQ ID NO: 140094 - RNA, 20 nt, Artificial Sequence
  mmSKRIPTE0010873_NTC_414
  gRNA
cggugaggaucccucuugcg

SEQ ID NO: 140095 - RNA, 20 nt, Artificial Sequence
  mmSKRIPTE0010874_NTC_415
  gRNA
cguaaaccauaacguugguc

SEQ ID NO: 140096 - RNA, 20 nt, Artificial Sequence
  mmSKRIPTE0010875_NTC_416
  gRNA
cguaaccggagauaauauua

SEQ ID NO: 140097 - RNA, 20 nt, Artificial Sequence
  mmSKRIPTE0010876_NTC_417
  gRNA
cguaccgacaguaguccaag

SEQ ID NO: 140098 - RNA, 20 nt, Artificial Sequence
  mmSKRIPTE0010877_NTC_418
  gRNA
cguacgggcgcgccguccau

SEQ ID NO: 140099 - RNA, 20 nt, Artificial Sequence
  mmSKRIPTE0010878_NTC_419
  gRNA
cguagaugccugcucgagca

SEQ ID NO: 140100 - RNA, 20 nt, Artificial Sequence
  mmSKRIPTE0010879_NTC_420
  gRNA
cgucaauguguccggacggu

SEQ ID NO: 140101 - RNA, 20 nt, Artificial Sequence
  mmSKRIPTE0010880_NTC_421
  gRNA
cgucaccgcuaguaaugaug

SEQ ID NO: 140102 - RNA, 20 nt, Artificial Sequence
  mmSKRIPTE0010881_NTC_422
  gRNA
cgucauggcaagaucgauaa

SEQ ID NO: 140103 - RNA, 20 nt, Artificial Sequence
  mmSKRIPTE0010882_NTC_423
  gRNA
cguccucgcagcguagacug

SEQ ID NO: 140104 - RNA, 20 nt, Artificial Sequence
  mmSKRIPTE0010883_NTC_424
  gRNA
cgucgaagauacgcaggcug

SEQ ID NO: 140105 - RNA, 20 nt, Artificial Sequence
  mmSKRIPTE0010884_NTC_425
  gRNA
cgucgaucccucuauacugg

SEQ ID NO: 140106 - RNA, 20 nt, Artificial Sequence
  mmSKRIPTE0010885_NTC_426
  gRNA
cgucgcauguuguugcucau

SEQ ID NO: 140107 - RNA, 20 nt, Artificial Sequence
  mmSKRIPTE0010886_NTC_427
  gRNA
cgugaaucgacccucaauaa

SEQ ID NO: 140108 - RNA, 20 nt, Artificial Sequence
  mmSKRIPTE0010887_NTC_428
  gRNA
cgugauuccuaagcccccgc

SEQ ID NO: 140109 - RNA, 20 nt, Artificial Sequence
  mmSKRIPTE0010888_NTC_429
  gRNA
cgugcguucguaauaaaagg

SEQ ID NO: 140110 - RNA, 20 nt, Artificial Sequence
  mmSKRIPTE0010889_NTC_430
  gRNA
cguguagucgggucgcaugu

SEQ ID NO: 140111 - RNA, 20 nt, Artificial Sequence
  mmSKRIPTE0010890_NTC_431
  gRNA
cguguguuuacagcccuuac

SEQ ID NO: 140112 - RNA, 20 nt, Artificial Sequence
  mmSKRIPTE0010891_NTC_432
  gRNA
cguguuuggcggccaacuuu

SEQ ID NO: 140113 - RNA, 20 nt, Artificial Sequence
  mmSKRIPTE0010892_NTC_433
  gRNA
cguguuuuaccucgcuucga

SEQ ID NO: 140114 - RNA, 20 nt, Artificial Sequence
  mmSKRIPTE0010893_NTC_434
  gRNA
cguuaauaaacgcgguuuca

SEQ ID NO: 140115 - RNA, 20 nt, Artificial Sequence
  mmSKRIPTE0010894_NTC_435
  gRNA
cguuaauccaccguaugggc

SEQ ID NO: 140116 - RNA, 20 nt, Artificial Sequence
  mmSKRIPTE0010895_NTC_436
  gRNA
cguuacguuucuugccagga

SEQ ID NO: 140117 - RNA, 20 nt, Artificial Sequence
  mmSKRIPTE0010896_NTC_437
  gRNA
cguuagaccgaaucuccggg

SEQ ID NO: 140118 - RNA, 20 nt, Artificial Sequence
  mmSKRIPTE0010897_NTC_438
  gRNA
cguuauaucuacacuuugcg

SEQ ID NO: 140119 - RNA, 20 nt, Artificial Sequence
  mmSKRIPTE0010898_NTC_439
  gRNA
cguuauuguacaccacgcuc

SEQ ID NO: 140120 - RNA, 20 nt, Artificial Sequence
  mmSKRIPTE0010899_NTC_440
  gRNA
cguugcgaauccacccuauu

SEQ ID NO: 140121 - RNA, 20 nt, Artificial Sequence
  mmSKRIPTE0010900_NTC_441
  gRNA
cguuguuuggagcccgucca

SEQ ID NO: 140122 - RNA, 20 nt, Artificial Sequence
  mmSKRIPTE0010901_NTC_442
  gRNA
cuaacagcgccguuaucuac

SEQ ID NO: 140123 - RNA, 20 nt, Artificial Sequence
  mmSKRIPTE0010902_NTC_443
  gRNA
cuaacgugguagcacuacaa

SEQ ID NO: 140124 - RNA, 20 nt, Artificial Sequence
  mmSKRIPTE0010903_NTC_444
  gRNA
cuaagucgacuguuucgacc

SEQ ID NO: 140125 - RNA, 20 nt, Artificial Sequence
  mmSKRIPTE0010904_NTC_445
  gRNA
cuaauacacccggacgguac

SEQ ID NO: 140126 - RNA, 20 nt, Artificial Sequence
  mmSKRIPTE0010905_NTC_446
  gRNA
cuaauacacuccuucuccgc

SEQ ID NO: 140127 - RNA, 20 nt, Artificial Sequence
  mmSKRIPTE0010906_NTC_447
  gRNA
cuaauuccaauauccgucug

SEQ ID NO: 140128 - RNA, 20 nt, Artificial Sequence
  mmSKRIPTE0010907_NTC_448
  gRNA
cuacccccgcugugcaacgu

SEQ ID NO: 140129 - RNA, 20 nt, Artificial Sequence
  mmSKRIPTE0010908_NTC_449
  gRNA
cuacccgucuauuacgaucu

SEQ ID NO: 140130 - RNA, 20 nt, Artificial Sequence
  mmSKRIPTE0010909_NTC_450
  gRNA
cuaccggucacguugugacc

SEQ ID NO: 140131 - RNA, 20 nt, Artificial Sequence
  mmSKRIPTE0010910_NTC_451
  gRNA
cuacgagauucggcuaagcu

SEQ ID NO: 140132 - RNA, 20 nt, Artificial Sequence
  mmSKRIPTE0010911_NTC_452
  gRNA
cuacgagggccgcgagcggu

SEQ ID NO: 140133 - RNA, 20 nt, Artificial Sequence
  mmSKRIPTE0010912_NTC_453
  gRNA
cuacggauaggcgcggguga

SEQ ID NO: 140134 - RNA, 20 nt, Artificial Sequence
  mmSKRIPTE0010913_NTC_454
  gRNA
cuacuugugacgaccucgcg

SEQ ID NO: 140135 - RNA, 20 nt, Artificial Sequence
  mmSKRIPTE0010914_NTC_455
  gRNA
cuaucggcccgcagugaugg

SEQ ID NO: 140136 - RNA, 20 nt, Artificial Sequence
  mmSKRIPTE0010915_NTC_456
  gRNA
cuauugggagcggccucucg

SEQ ID NO: 140137 - RNA, 20 nt, Artificial Sequence
  mmSKRIPTE0010916_NTC_457
  gRNA
cucaaaccuccguuaccccg

SEQ ID NO: 140138 - RNA, 20 nt, Artificial Sequence
  mmSKRIPTE0010917_NTC_458
  gRNA
cucauguacgccuucgcuac

SEQ ID NO: 140139 - RNA, 20 nt, Artificial Sequence
  mmSKRIPTE0010918_NTC_459
  gRNA
cucccauccccguagcggcc

SEQ ID NO: 140140 - RNA, 20 nt, Artificial Sequence
  mmSKRIPTE0010919_NTC_460
  gRNA
cuccgacgacuacgcaagga

SEQ ID NO: 140141 - RNA, 20 nt, Artificial Sequence
  mmSKRIPTE0010920_NTC_461
  gRNA
cuccggacgugcauccgaga

SEQ ID NO: 140142 - RNA, 20 nt, Artificial Sequence
  mmSKRIPTE0010921_NTC_462
  gRNA
cuccucgaggcuggcuacgu

SEQ ID NO: 140143 - RNA, 20 nt, Artificial Sequence
  mmSKRIPTE0010922_NTC_463
  gRNA
cucgacccaguaguagacgg

SEQ ID NO: 140144 - RNA, 20 nt, Artificial Sequence
  mmSKRIPTE0010923_NTC_464
  gRNA
cucgaugccacggaaggcgg

SEQ ID NO: 140145 - RNA, 20 nt, Artificial Sequence
  mmSKRIPTE0010924_NTC_465
  gRNA
cucggacggcauacgacaau

SEQ ID NO: 140146 - RNA, 20 nt, Artificial Sequence
  mmSKRIPTE0010925_NTC_466
  gRNA
cucggagauucguuagaaga

SEQ ID NO: 140147 - RNA, 20 nt, Artificial Sequence
  mmSKRIPTE0010926_NTC_467
  gRNA
cucggaugguguguugaacc

SEQ ID NO: 140148 - RNA, 20 nt, Artificial Sequence
  mmSKRIPTE0010927_NTC_468
  gRNA
cucggcuuuacgaucgauca

SEQ ID NO: 140149 - RNA, 20 nt, Artificial Sequence
  mmSKRIPTE0010928_NTC_469
  gRNA
cucgggcuauucagcgauag

SEQ ID NO: 140150 - RNA, 20 nt, Artificial Sequence
  mmSKRIPTE0010929_NTC_470
  gRNA
cucguauaguauugcguggu

SEQ ID NO: 140151 - RNA, 20 nt, Artificial Sequence
  mmSKRIPTE0010930_NTC_471
  gRNA
cucguaucuuuucccacggc

SEQ ID NO: 140152 - RNA, 20 nt, Artificial Sequence
  mmSKRIPTE0010931_NTC_472
  gRNA
cucgucggcuuucgugcugc

SEQ ID NO: 140153 - RNA, 20 nt, Artificial Sequence
  mmSKRIPTE0010932_NTC_473
  gRNA
cucgugaaacaagauccgac

SEQ ID NO: 140154 - RNA, 20 nt, Artificial Sequence
  mmSKRIPTE0010933_NTC_474
  gRNA
cucgugaaccuguucgcgca

SEQ ID NO: 140155 - RNA, 20 nt, Artificial Sequence
  mmSKRIPTE0010934_NTC_475
  gRNA
cucgugucacuccucgguuc

SEQ ID NO: 140156 - RNA, 20 nt, Artificial Sequence
  mmSKRIPTE0010935_NTC_476
  gRNA
cucuaauaaaccgcacaagc

SEQ ID NO: 140157 - RNA, 20 nt, Artificial Sequence
  mmSKRIPTE0010936_NTC_477
  gRNA
cucucugcgagucgaugauu

SEQ ID NO: 140158 - RNA, 20 nt, Artificial Sequence
  mmSKRIPTE0010937_NTC_478
  gRNA
cugaucggugcauaucucgg

SEQ ID NO: 140159 - RNA, 20 nt, Artificial Sequence
  mmSKRIPTE0010938_NTC_479
  gRNA
cugcacggcacgacauccaa

SEQ ID NO: 140160 - RNA, 20 nt, Artificial Sequence
  mmSKRIPTE0010939_NTC_480
  gRNA
cugcguguaacguguuggga

SEQ ID NO: 140161 - RNA, 20 nt, Artificial Sequence
  mmSKRIPTE0010940_NTC_481
  gRNA
cugcuugaacgccuagacgg

SEQ ID NO: 140162 - RNA, 20 nt, Artificial Sequence
  mmSKRIPTE0010941_NTC_482
  gRNA
cuggggccgcugaaccgccg

SEQ ID NO: 140163 - RNA, 20 nt, Artificial Sequence
  mmSKRIPTE0010942_NTC_483
  gRNA
cugucuucaacgucuggccg

SEQ ID NO: 140164 - RNA, 20 nt, Artificial Sequence
  mmSKRIPTE0010943_NTC_484
  gRNA
cuuaaguucgcgacggaaug

SEQ ID NO: 140165 - RNA, 20 nt, Artificial Sequence
  mmSKRIPTE0010944_NTC_485
  gRNA
cuuauccauaauaggcggcg

SEQ ID NO: 140166 - RNA, 20 nt, Artificial Sequence
  mmSKRIPTE0010945_NTC_486
  gRNA
cuuaucgauuuggguucaac

SEQ ID NO: 140167 - RNA, 20 nt, Artificial Sequence
  mmSKRIPTE0010946_NTC_487
  gRNA
cuucacgccuuggaccgaua

SEQ ID NO: 140168 - RNA, 20 nt, Artificial Sequence
  mmSKRIPTE0010947_NTC_488
  gRNA
cuugaaaaaggggcgacuau

SEQ ID NO: 140169 - RNA, 20 nt, Artificial Sequence
  mmSKRIPTE0010948_NTC_489
  gRNA
cuugacaccucguccgcauc

SEQ ID NO: 140170 - RNA, 20 nt, Artificial Sequence
  mmSKRIPTE0010949_NTC_490
  gRNA
cuuuagucacgauauacguc

SEQ ID NO: 140171 - RNA, 20 nt, Artificial Sequence
  mmSKRIPTE0010950_NTC_491
  gRNA
cuuuauaccgcgcgucggca

SEQ ID NO: 140172 - RNA, 20 nt, Artificial Sequence
  mmSKRIPTE0010951_NTC_492
  gRNA
cuuuauuccguugcaugucg

SEQ ID NO: 140173 - RNA, 20 nt, Artificial Sequence
  mmSKRIPTE0010952_NTC_493
  gRNA
cuuuggcgucgagaagcgca

SEQ ID NO: 140174 - RNA, 20 nt, Artificial Sequence
  mmSKRIPTE0010953_NTC_494
  gRNA
gaaccacgagcgagcguaua

SEQ ID NO: 140175 - RNA, 20 nt, Artificial Sequence
  mmSKRIPTE0010954_NTC_495
  gRNA
gaaccaguaucuaacccgac

SEQ ID NO: 140176 - RNA, 20 nt, Artificial Sequence
  mmSKRIPTE0010955_NTC_496
  gRNA
gaacccgggaaacacguccg

SEQ ID NO: 140177 - RNA, 20 nt, Artificial Sequence
  mmSKRIPTE0010956_NTC_497
  gRNA
gaaccggcgugcguuagcgg

SEQ ID NO: 140178 - RNA, 20 nt, Artificial Sequence
  mmSKRIPTE0010957_NTC_498
  gRNA
gaaccuucgcgcaacuuaac

SEQ ID NO: 140179 - RNA, 20 nt, Artificial Sequence
  mmSKRIPTE0010958_NTC_499
  gRNA
gaacguaacggcaugcauca

SEQ ID NO: 140180 - RNA, 20 nt, Artificial Sequence
  mmSKRIPTE0010959_NTC_500
  gRNA
gaacucguuaggccgugaag

SEQ ID NO: 140181 - RNA, 20 nt, Artificial Sequence
  mmSKRIPTE0010960_NTC_501
  gRNA
gaauugagccgcaacucggc

SEQ ID NO: 140182 - RNA, 20 nt, Artificial Sequence
  mmSKRIPTE0010961_NTC_502
  gRNA
gacaaucgacacgccgcuuc

SEQ ID NO: 140183 - RNA, 20 nt, Artificial Sequence
  mmSKRIPTE0010962_NTC_503
  gRNA
gacagccgguugaccggguc

SEQ ID NO: 140184 - RNA, 20 nt, Artificial Sequence
  mmSKRIPTE0010963_NTC_504
  gRNA
gacaguugacgcgacggaga

SEQ ID NO: 140185 - RNA, 20 nt, Artificial Sequence
  mmSKRIPTE0010964_NTC_505
  gRNA
gacaguuggauaaccguguc

SEQ ID NO: 140186 - RNA, 20 nt, Artificial Sequence
  mmSKRIPTE0010965_NTC_506
  gRNA
gaccaaccuuacgguaacuc

SEQ ID NO: 140187 - RNA, 20 nt, Artificial Sequence
  mmSKRIPTE0010966_NTC_507
  gRNA
gaccacuauguacuuaucgc

SEQ ID NO: 140188 - RNA, 20 nt, Artificial Sequence
  mmSKRIPTE0010967_NTC_508
  gRNA
gaccauacgccucguaugcc

SEQ ID NO: 140189 - RNA, 20 nt, Artificial Sequence
  mmSKRIPTE0010968_NTC_509
  gRNA
gaccgacgguauacccuacu

SEQ ID NO: 140190 - RNA, 20 nt, Artificial Sequence
  mmSKRIPTE0010969_NTC_510
  gRNA
gaccggccaacgguagcggc

SEQ ID NO: 140191 - RNA, 20 nt, Artificial Sequence
  mmSKRIPTE0010970_NTC_511
  gRNA
gaccgguguguuuacgcgug

SEQ ID NO: 140192 - RNA, 20 nt, Artificial Sequence
  mmSKRIPTE0010971_NTC_512
  gRNA
gaccgucgggauccuuaauu

SEQ ID NO: 140193 - RNA, 20 nt, Artificial Sequence
  mmSKRIPTE0010972_NTC_513
  gRNA
gaccucgcaauugagcgcuc

SEQ ID NO: 140194 - RNA, 20 nt, Artificial Sequence
  mmSKRIPTE0010973_NTC_514
  gRNA
gacgaaagguccuacgaagu

SEQ ID NO: 140195 - RNA, 20 nt, Artificial Sequence
  mmSKRIPTE0010974_NTC_515
  gRNA
gacgguccccccuaugaaau

SEQ ID NO: 140196 - RNA, 20 nt, Artificial Sequence
  mmSKRIPTE0010975_NTC_516
  gRNA
gacguauuggauucgcaacc

SEQ ID NO: 140197 - RNA, 20 nt, Artificial Sequence
  mmSKRIPTE0010976_NTC_517
  gRNA
gacgucuaauuucuggccgu

SEQ ID NO: 140198 - RNA, 20 nt, Artificial Sequence
  mmSKRIPTE0010977_NTC_518
  gRNA
gacuagcacgaacugcgguu

SEQ ID NO: 140199 - RNA, 20 nt, Artificial Sequence
  mmSKRIPTE0010978_NTC_519
  gRNA
gacuccggguacuaaauguc

SEQ ID NO: 140200 - RNA, 20 nt, Artificial Sequence
  mmSKRIPTE0010979_NTC_520
  gRNA
gacuucgacgagaaaacguu

SEQ ID NO: 140201 - RNA, 20 nt, Artificial Sequence
  mmSKRIPTE0010980_NTC_521
  gRNA
gagacccauuaugauccuag

SEQ ID NO: 140202 - RNA, 20 nt, Artificial Sequence
  mmSKRIPTE0010981_NTC_522
  gRNA
gagauuaaauuaacgccggc

SEQ ID NO: 140203 - RNA, 20 nt, Artificial Sequence
  mmSKRIPTE0010982_NTC_523
  gRNA
gagauucgauacugcgguca

SEQ ID NO: 140204 - RNA, 20 nt, Artificial Sequence
  mmSKRIPTE0010983_NTC_524
  gRNA
gagccccaacgcgcgaagca

SEQ ID NO: 140205 - RNA, 20 nt, Artificial Sequence
  mmSKRIPTE0010984_NTC_525
  gRNA
gagcgccaagcgugcguuga

SEQ ID NO: 140206 - RNA, 20 nt, Artificial Sequence
  mmSKRIPTE0010985_NTC_526
  gRNA
gagcgcgggccagcgaacgu

SEQ ID NO: 140207 - RNA, 20 nt, Artificial Sequence
  mmSKRIPTE0010986_NTC_527
  gRNA
gagcgucccgugauuuaaag

SEQ ID NO: 140208 - RNA, 20 nt, Artificial Sequence
  mmSKRIPTE0010987_NTC_528
  gRNA
gagcuaaucuguagacgucg

SEQ ID NO: 140209 - RNA, 20 nt, Artificial Sequence
  mmSKRIPTE0010988_NTC_529
  gRNA
gaggaccuagguucccggau

SEQ ID NO: 140210 - RNA, 20 nt, Artificial Sequence
  mmSKRIPTE0010989_NTC_530
  gRNA
gaggcgggcucuucuaucgu

SEQ ID NO: 140211 - RNA, 20 nt, Artificial Sequence
  mmSKRIPTE0010990_NTC_531
  gRNA
gaggcguacuucggcucuaa

SEQ ID NO: 140212 - RNA, 20 nt, Artificial Sequence
  mmSKRIPTE0010991_NTC_532
  gRNA
gagucgaguuaauaacgcuc

SEQ ID NO: 140213 - RNA, 20 nt, Artificial Sequence
  mmSKRIPTE0010992_NTC_533
  gRNA
gauaagacuccgcgagcuuc

SEQ ID NO: 140214 - RNA, 20 nt, Artificial Sequence
  mmSKRIPTE0010993_NTC_534
  gRNA
gauacgugagguugccggug

SEQ ID NO: 140215 - RNA, 20 nt, Artificial Sequence
  mmSKRIPTE0010994_NTC_535
  gRNA
gauagaacaacagcggugca

SEQ ID NO: 140216 - RNA, 20 nt, Artificial Sequence
  mmSKRIPTE0010995_NTC_536
  gRNA
gauauuuaccggcgauaaga

SEQ ID NO: 140217 - RNA, 20 nt, Artificial Sequence
  mmSKRIPTE0010996_NTC_537
  gRNA
gaucacucccgaaaguagug

SEQ ID NO: 140218 - RNA, 20 nt, Artificial Sequence
  mmSKRIPTE0010997_NTC_538
  gRNA
gauccccuacgcuucaaccu

SEQ ID NO: 140219 - RNA, 20 nt, Artificial Sequence
  mmSKRIPTE0010998_NTC_539
  gRNA
gaucgagugacacccacccg

SEQ ID NO: 140220 - RNA, 20 nt, Artificial Sequence
  mmSKRIPTE0010999_NTC_540
  gRNA
gaucuuaccacucgucguag

SEQ ID NO: 140221 - RNA, 20 nt, Artificial Sequence
  mmSKRIPTE0011000_NTC_541
  gRNA
gaugcggacccacguuaagc

SEQ ID NO: 140222 - RNA, 20 nt, Artificial Sequence
  mmSKRIPTE0011001_NTC_542
  gRNA
gaugcggguggaaaacguua

SEQ ID NO: 140223 - RNA, 20 nt, Artificial Sequence
  mmSKRIPTE0011002_NTC_543
  gRNA
gauggccaguaacggcguca

SEQ ID NO: 140224 - RNA, 20 nt, Artificial Sequence
  mmSKRIPTE0011003_NTC_544
  gRNA
gauuacgggguuccguaacu

SEQ ID NO: 140225 - RNA, 20 nt, Artificial Sequence
  mmSKRIPTE0011004_NTC_545
  gRNA
gauucauuaucggcauacgg

SEQ ID NO: 140226 - RNA, 20 nt, Artificial Sequence
  mmSKRIPTE0011005_NTC_546
  gRNA
gauuccguauaguaaucgag

SEQ ID NO: 140227 - RNA, 20 nt, Artificial Sequence
  mmSKRIPTE0011006_NTC_547
  gRNA
gauugagaagccgcgguauc

SEQ ID NO: 140228 - RNA, 20 nt, Artificial Sequence
  mmSKRIPTE0011007_NTC_548
  gRNA
gauuggacggucgcaggaua

SEQ ID NO: 140229 - RNA, 20 nt, Artificial Sequence
  mmSKRIPTE0011008_NTC_549
  gRNA
gauuucucguaucggauaac

SEQ ID NO: 140230 - RNA, 20 nt, Artificial Sequence
  mmSKRIPTE0011009_NTC_550
  gRNA
gcaaaaagcggacacgcgac

SEQ ID NO: 140231 - RNA, 20 nt, Artificial Sequence
  mmSKRIPTE0011010_NTC_551
  gRNA
gcaaauaggucggagcgugu

SEQ ID NO: 140232 - RNA, 20 nt, Artificial Sequence
  mmSKRIPTE0011011_NTC_552
  gRNA
gcaacccacggacggcaccg

SEQ ID NO: 140233 - RNA, 20 nt, Artificial Sequence
  mmSKRIPTE0011012_NTC_553
  gRNA
gcaacggacagucaucgaac

SEQ ID NO: 140234 - RNA, 20 nt, Artificial Sequence
  mmSKRIPTE0011013_NTC_554
  gRNA
gcaauagucgcacgggugau

SEQ ID NO: 140235 - RNA, 20 nt, Artificial Sequence
  mmSKRIPTE0011014_NTC_555
  gRNA
gcaauucugcaacgcacguc

SEQ ID NO: 140236 - RNA, 20 nt, Artificial Sequence
  mmSKRIPTE0011015_NTC_556
  gRNA
gcaccucuagcgcgcucggc

SEQ ID NO: 140237 - RNA, 20 nt, Artificial Sequence
  mmSKRIPTE0011016_NTC_557
  gRNA
gcacgaacccguucguaugg

SEQ ID NO: 140238 - RNA, 20 nt, Artificial Sequence
  mmSKRIPTE0011017_NTC_558
  gRNA
gcagagcguaaucggcaucg

SEQ ID NO: 140239 - RNA, 20 nt, Artificial Sequence
  mmSKRIPTE0011018_NTC_559
  gRNA
gcaggguuauuccgcuucua

SEQ ID NO: 140240 - RNA, 20 nt, Artificial Sequence
  mmSKRIPTE0011019_NTC_560
  gRNA
gcagguaggcucgauacuug

SEQ ID NO: 140241 - RNA, 20 nt, Artificial Sequence
  mmSKRIPTE0011020_NTC_561
  gRNA
gcauaacggccgagcaccac

SEQ ID NO: 140242 - RNA, 20 nt, Artificial Sequence
  mmSKRIPTE0011021_NTC_562
  gRNA
gcaugcgcucgcguggacug

SEQ ID NO: 140243 - RNA, 20 nt, Artificial Sequence
  mmSKRIPTE0011022_NTC_563
  gRNA
gcauuaagacgcccacauau

SEQ ID NO: 140244 - RNA, 20 nt, Artificial Sequence
  mmSKRIPTE0011023_NTC_564
  gRNA
gcauucccgcuuacguaauu

SEQ ID NO: 140245 - RNA, 20 nt, Artificial Sequence
  mmSKRIPTE0011024_NTC_565
  gRNA
gcauucuugagcuccgcgcc

SEQ ID NO: 140246 - RNA, 20 nt, Artificial Sequence
  mmSKRIPTE0011025_NTC_566
  gRNA
gcauuggugcucgcgcguuc

SEQ ID NO: 140247 - RNA, 20 nt, Artificial Sequence
  mmSKRIPTE0011026_NTC_567
  gRNA
gccacgaccugcgaauaauu

SEQ ID NO: 140248 - RNA, 20 nt, Artificial Sequence
  mmSKRIPTE0011027_NTC_568
  gRNA
gccacuccgcucguucuaga

SEQ ID NO: 140249 - RNA, 20 nt, Artificial Sequence
  mmSKRIPTE0011028_NTC_569
  gRNA
gccagccucgguauaacucg

SEQ ID NO: 140250 - RNA, 20 nt, Artificial Sequence
  mmSKRIPTE0011029_NTC_570
  gRNA
gccauagccaaucgcuaguu

SEQ ID NO: 140251 - RNA, 20 nt, Artificial Sequence
  mmSKRIPTE0011030_NTC_571
  gRNA
gcccaugacgcguguuagua

SEQ ID NO: 140252 - RNA, 20 nt, Artificial Sequence
  mmSKRIPTE0011031_NTC_572
  gRNA
gcccgaccuccacguaaauc

SEQ ID NO: 140253 - RNA, 20 nt, Artificial Sequence
  mmSKRIPTE0011032_NTC_573
  gRNA
gcccgagcggauucaccgcg

SEQ ID NO: 140254 - RNA, 20 nt, Artificial Sequence
  mmSKRIPTE0011033_NTC_574
  gRNA
gcccgauagaauuacccauu

SEQ ID NO: 140255 - RNA, 20 nt, Artificial Sequence
  mmSKRIPTE0011034_NTC_575
  gRNA
gcccguugugagcggcaugc

SEQ ID NO: 140256 - RNA, 20 nt, Artificial Sequence
  mmSKRIPTE0011035_NTC_576
  gRNA
gcccucgagcucacgaugag

SEQ ID NO: 140257 - RNA, 20 nt, Artificial Sequence
  mmSKRIPTE0011036_NTC_577
  gRNA
gccgaaucgcguuauuccaa

SEQ ID NO: 140258 - RNA, 20 nt, Artificial Sequence
  mmSKRIPTE0011037_NTC_578
  gRNA
gccgaccaacgaugaccacg

SEQ ID NO: 140259 - RNA, 20 nt, Artificial Sequence
  mmSKRIPTE0011038_NTC_579
  gRNA
gccgagaggcguaagcgcga

SEQ ID NO: 140260 - RNA, 20 nt, Artificial Sequence
  mmSKRIPTE0011039_NTC_580
  gRNA
gccgcaacguuagauguaua

SEQ ID NO: 140261 - RNA, 20 nt, Artificial Sequence
  mmSKRIPTE0011040_NTC_581
  gRNA
gccgcgccauaauaugccau

SEQ ID NO: 140262 - RNA, 20 nt, Artificial Sequence
  mmSKRIPTE0011041_NTC_582
  gRNA
gccgcucuugauaacgacgc

SEQ ID NO: 140263 - RNA, 20 nt, Artificial Sequence
  mmSKRIPTE0011042_NTC_583
  gRNA
gccguaagcgggccgguuga

SEQ ID NO: 140264 - RNA, 20 nt, Artificial Sequence
  mmSKRIPTE0011043_NTC_584
  gRNA
gccguuggaaaacuccggcc

SEQ ID NO: 140265 - RNA, 20 nt, Artificial Sequence
  mmSKRIPTE0011044_NTC_585
  gRNA
gccuaugugaaucgcgaauu

SEQ ID NO: 140266 - RNA, 20 nt, Artificial Sequence
  mmSKRIPTE0011045_NTC_586
  gRNA
gccuuccucgcagacccgac

SEQ ID NO: 140267 - RNA, 20 nt, Artificial Sequence
  mmSKRIPTE0011046_NTC_587
  gRNA
gccuuuuccgcccguucaag

SEQ ID NO: 140268 - RNA, 20 nt, Artificial Sequence
  mmSKRIPTE0011047_NTC_588
  gRNA
gcgacaagcguugaguucgc

SEQ ID NO: 140269 - RNA, 20 nt, Artificial Sequence
  mmSKRIPTE0011048_NTC_589
  gRNA
gcgacguguaucgaucacuc

SEQ ID NO: 140270 - RNA, 20 nt, Artificial Sequence
  mmSKRIPTE0011049_NTC_590
  gRNA
gcgagcgcuaucccggugga

SEQ ID NO: 140271 - RNA, 20 nt, Artificial Sequence
  mmSKRIPTE0011050_NTC_591
  gRNA
gcgagguauucggcuccgcg

SEQ ID NO: 140272 - RNA, 20 nt, Artificial Sequence
  mmSKRIPTE0011051_NTC_592
  gRNA
gcgaguuauuucgcuauagg

SEQ ID NO: 140273 - RNA, 20 nt, Artificial Sequence
  mmSKRIPTE0011052_NTC_593
  gRNA
gcgaucgccgguauagcuuu

SEQ ID NO: 140274 - RNA, 20 nt, Artificial Sequence
  mmSKRIPTE0011053_NTC_594
  gRNA
gcgauuaucaguaguccacg

SEQ ID NO: 140275 - RNA, 20 nt, Artificial Sequence
  mmSKRIPTE0011054_NTC_595
  gRNA
gcgccuaggguuccgacuca

SEQ ID NO: 140276 - RNA, 20 nt, Artificial Sequence
  mmSKRIPTE0011055_NTC_596
  gRNA
gcgcgagggcaccgacaagu

SEQ ID NO: 140277 - RNA, 20 nt, Artificial Sequence
  mmSKRIPTE0011056_NTC_597
  gRNA
gcgcgagugccaaacgagug

SEQ ID NO: 140278 - RNA, 20 nt, Artificial Sequence
  mmSKRIPTE0011057_NTC_598
  gRNA
gcgcgcguggaucacccgca

SEQ ID NO: 140279 - RNA, 20 nt, Artificial Sequence
  mmSKRIPTE0011058_NTC_599
  gRNA
gcgcguacauauaaauaggu

SEQ ID NO: 140280 - RNA, 20 nt, Artificial Sequence
  mmSKRIPTE0011059_NTC_600
  gRNA
gcgcuacucccaccgauguu

SEQ ID NO: 140281 - RNA, 20 nt, Artificial Sequence
  mmSKRIPTE0011060_NTC_601
  gRNA
gcgcucgaacaaacaugguc

SEQ ID NO: 140282 - RNA, 20 nt, Artificial Sequence
  mmSKRIPTE0011061_NTC_602
  gRNA
gcgcucguucgagacgaucu

SEQ ID NO: 140283 - RNA, 20 nt, Artificial Sequence
  mmSKRIPTE0011062_NTC_603
  gRNA
gcggaucugacgguuacuua

SEQ ID NO: 140284 - RNA, 20 nt, Artificial Sequence
  mmSKRIPTE0011063_NTC_604
  gRNA
gcggcccgugaccguucaau

SEQ ID NO: 140285 - RNA, 20 nt, Artificial Sequence
  mmSKRIPTE0011064_NTC_605
  gRNA
gcgggacccccgguauaguc

SEQ ID NO: 140286 - RNA, 20 nt, Artificial Sequence
  mmSKRIPTE0011065_NTC_606
  gRNA
gcgguuaccgcgaaaaccau

SEQ ID NO: 140287 - RNA, 20 nt, Artificial Sequence
  mmSKRIPTE0011066_NTC_607
  gRNA
gcguaccuaucgauaaacca

SEQ ID NO: 140288 - RNA, 20 nt, Artificial Sequence
  mmSKRIPTE0011067_NTC_608
  gRNA
gcguaucuacccuaccgccg

SEQ ID NO: 140289 - RNA, 20 nt, Artificial Sequence
  mmSKRIPTE0011068_NTC_609
  gRNA
gcgugacgcgaucaaacggu

SEQ ID NO: 140290 - RNA, 20 nt, Artificial Sequence
  mmSKRIPTE0011069_NTC_610
  gRNA
gcgugacgucccacccugag

SEQ ID NO: 140291 - RNA, 20 nt, Artificial Sequence
  mmSKRIPTE0011070_NTC_611
  gRNA
gcgugagauucguugcucga

SEQ ID NO: 140292 - RNA, 20 nt, Artificial Sequence
  mmSKRIPTE0011071_NTC_612
  gRNA
gcgugccaugggaggccguu

SEQ ID NO: 140293 - RNA, 20 nt, Artificial Sequence
  mmSKRIPTE0011072_NTC_613
  gRNA
gcguggaguucgucgcucuu

SEQ ID NO: 140294 - RNA, 20 nt, Artificial Sequence
  mmSKRIPTE0011073_NTC_614
  gRNA
gcgugguacucacaucgcga

SEQ ID NO: 140295 - RNA, 20 nt, Artificial Sequence
  mmSKRIPTE0011074_NTC_615
  gRNA
gcuaaaaacaaccggcgcgg

SEQ ID NO: 140296 - RNA, 20 nt, Artificial Sequence
  mmSKRIPTE0011075_NTC_616
  gRNA
gcuaaacguauuuuacgggc

SEQ ID NO: 140297 - RNA, 20 nt, Artificial Sequence
  mmSKRIPTE0011076_NTC_617
  gRNA
gcuaagauucauccgaacac

SEQ ID NO: 140298 - RNA, 20 nt, Artificial Sequence
  mmSKRIPTE0011077_NTC_618
  gRNA
gcuaaucgguacuacuccgg

SEQ ID NO: 140299 - RNA, 20 nt, Artificial Sequence
  mmSKRIPTE0011078_NTC_619
  gRNA
gcuacagauuugcguucgag

SEQ ID NO: 140300 - RNA, 20 nt, Artificial Sequence
  mmSKRIPTE0011079_NTC_620
  gRNA
gcuagcguucagcccgaugu

SEQ ID NO: 140301 - RNA, 20 nt, Artificial Sequence
  mmSKRIPTE0011080_NTC_621
  gRNA
gcuaguucucccgggcgaaa

SEQ ID NO: 140302 - RNA, 20 nt, Artificial Sequence
  mmSKRIPTE0011081_NTC_622
  gRNA
gcuauuccgcucgucaauuu

SEQ ID NO: 140303 - RNA, 20 nt, Artificial Sequence
  mmSKRIPTE0011082_NTC_623
  gRNA
gcucauacugaugaacgucc

SEQ ID NO: 140304 - RNA, 20 nt, Artificial Sequence
  mmSKRIPTE0011083_NTC_624
  gRNA
gcuccaggugcgagauaggc

SEQ ID NO: 140305 - RNA, 20 nt, Artificial Sequence
  mmSKRIPTE0011084_NTC_625
  gRNA
gcucgaaaguacgcuuccuu

SEQ ID NO: 140306 - RNA, 20 nt, Artificial Sequence
  mmSKRIPTE0011085_NTC_626
  gRNA
gcucgcugauguguaauccg

SEQ ID NO: 140307 - RNA, 20 nt, Artificial Sequence
  mmSKRIPTE0011086_NTC_627
  gRNA
gcucggaccuuuuagacguc

SEQ ID NO: 140308 - RNA, 20 nt, Artificial Sequence
  mmSKRIPTE0011087_NTC_628
  gRNA
gcugauuagacccggcguaa

SEQ ID NO: 140309 - RNA, 20 nt, Artificial Sequence
  mmSKRIPTE0011088_NTC_629
  gRNA
gcuuaccuacuccgccccgc

SEQ ID NO: 140310 - RNA, 20 nt, Artificial Sequence
  mmSKRIPTE0011089_NTC_630
  gRNA
gcuuaucgucaugcggguga

SEQ ID NO: 140311 - RNA, 20 nt, Artificial Sequence
  mmSKRIPTE0011090_NTC_631
  gRNA
gcuuaucguuccgcuacgau

SEQ ID NO: 140312 - RNA, 20 nt, Artificial Sequence
  mmSKRIPTE0011091_NTC_632
  gRNA
gcuucauuauuaaccggcgu

SEQ ID NO: 140313 - RNA, 20 nt, Artificial Sequence
  mmSKRIPTE0011092_NTC_633
  gRNA
gcuucgaccacggguacugc

SEQ ID NO: 140314 - RNA, 20 nt, Artificial Sequence
  mmSKRIPTE0011093_NTC_634
  gRNA
gcuucggaggcuacguagua

SEQ ID NO: 140315 - RNA, 20 nt, Artificial Sequence
  mmSKRIPTE0011094_NTC_635
  gRNA
gcuucuacucgcaacguauu

SEQ ID NO: 140316 - RNA, 20 nt, Artificial Sequence
  mmSKRIPTE0011095_NTC_636
  gRNA
gcuugaggcaacgcgacuga

SEQ ID NO: 140317 - RNA, 20 nt, Artificial Sequence
  mmSKRIPTE0011096_NTC_637
  gRNA
gcuuguaaucuaaagacgcg

SEQ ID NO: 140318 - RNA, 20 nt, Artificial Sequence
  mmSKRIPTE0011097_NTC_638
  gRNA
gcuuucacggagguucgacg

SEQ ID NO: 140319 - RNA, 20 nt, Artificial Sequence
  mmSKRIPTE0011098_NTC_639
  gRNA
ggaaacguuacauucgacgc

SEQ ID NO: 140320 - RNA, 20 nt, Artificial Sequence
  mmSKRIPTE0011099_NTC_640
  gRNA
ggaaacucuugcucgacacg

SEQ ID NO: 140321 - RNA, 20 nt, Artificial Sequence
  mmSKRIPTE0011100_NTC_641
  gRNA
ggacacucgccgaccccacu

SEQ ID NO: 140322 - RNA, 20 nt, Artificial Sequence
  mmSKRIPTE0011101_NTC_642
  gRNA
ggaccaauguuaccguaggu

SEQ ID NO: 140323 - RNA, 20 nt, Artificial Sequence
  mmSKRIPTE0011102_NTC_643
  gRNA
ggacggaugggacgacuagu

SEQ ID NO: 140324 - RNA, 20 nt, Artificial Sequence
  mmSKRIPTE0011103_NTC_644
  gRNA
ggacguagauuagggcguaa

SEQ ID NO: 140325 - RNA, 20 nt, Artificial Sequence
  mmSKRIPTE0011104_NTC_645
  gRNA
ggacugaaaccgauaguauc

SEQ ID NO: 140326 - RNA, 20 nt, Artificial Sequence
  mmSKRIPTE0011105_NTC_646
  gRNA
ggagucucacgcaauuagcg

SEQ ID NO: 140327 - RNA, 20 nt, Artificial Sequence
  mmSKRIPTE0011106_NTC_647
  gRNA
ggaguucaagcguaacuucg

SEQ ID NO: 140328 - RNA, 20 nt, Artificial Sequence
  mmSKRIPTE0011107_NTC_648
  gRNA
ggauacaucggcgcgcuagu

SEQ ID NO: 140329 - RNA, 20 nt, Artificial Sequence
  mmSKRIPTE0011108_NTC_649
  gRNA
ggauagcccgguuggugcgu

SEQ ID NO: 140330 - RNA, 20 nt, Artificial Sequence
  mmSKRIPTE0011109_NTC_650
  gRNA
ggauauucgcgcggucuuca

SEQ ID NO: 140331 - RNA, 20 nt, Artificial Sequence
  mmSKRIPTE0011110_NTC_651
  gRNA
ggaucgauccgaggaacgug

SEQ ID NO: 140332 - RNA, 20 nt, Artificial Sequence
  mmSKRIPTE0011111_NTC_652
  gRNA
ggauucgugcgggagauacg

SEQ ID NO: 140333 - RNA, 20 nt, Artificial Sequence
  mmSKRIPTE0011112_NTC_653
  gRNA
ggauugacgagacgauaucg

SEQ ID NO: 140334 - RNA, 20 nt, Artificial Sequence
  mmSKRIPTE0011113_NTC_654
  gRNA
ggcaacgcacgcuggguugu

SEQ ID NO: 140335 - RNA, 20 nt, Artificial Sequence
  mmSKRIPTE0011114_NTC_655
  gRNA
ggcaccgcguuuauugcacu

SEQ ID NO: 140336 - RNA, 20 nt, Artificial Sequence
  mmSKRIPTE0011115_NTC_656
  gRNA
ggcaccguucggaaaccgac

SEQ ID NO: 140337 - RNA, 20 nt, Artificial Sequence
  mmSKRIPTE0011116_NTC_657
  gRNA
ggcagccuaaucagucgagg

SEQ ID NO: 140338 - RNA, 20 nt, Artificial Sequence
  mmSKRIPTE0011117_NTC_658
  gRNA
ggccaguguggccguuacgc

SEQ ID NO: 140339 - RNA, 20 nt, Artificial Sequence
  mmSKRIPTE0011118_NTC_659
  gRNA
ggcccaacgaaacuagcgug

SEQ ID NO: 140340 - RNA, 20 nt, Artificial Sequence
  mmSKRIPTE0011119_NTC_660
  gRNA
ggcccgaagggucacaagcg

SEQ ID NO: 140341 - RNA, 20 nt, Artificial Sequence
  mmSKRIPTE0011120_NTC_661
  gRNA
ggcgcuacuguaaugacggu

SEQ ID NO: 140342 - RNA, 20 nt, Artificial Sequence
  mmSKRIPTE0011121_NTC_662
  gRNA
ggcggguuaggccccguuuu

SEQ ID NO: 140343 - RNA, 20 nt, Artificial Sequence
  mmSKRIPTE0011122_NTC_663
  gRNA
ggcgucguaacaagaacuug

SEQ ID NO: 140344 - RNA, 20 nt, Artificial Sequence
  mmSKRIPTE0011123_NTC_664
  gRNA
ggcuuauagacgagacucga

SEQ ID NO: 140345 - RNA, 20 nt, Artificial Sequence
  mmSKRIPTE0011124_NTC_665
  gRNA
ggcuuuacguaaggagcgua

SEQ ID NO: 140346 - RNA, 20 nt, Artificial Sequence
  mmSKRIPTE0011125_NTC_666
  gRNA
gggacgcucaucgagugacg

SEQ ID NO: 140347 - RNA, 20 nt, Artificial Sequence
  mmSKRIPTE0011126_NTC_667
  gRNA
gggcaacgucaucuggcgac

SEQ ID NO: 140348 - RNA, 20 nt, Artificial Sequence
  mmSKRIPTE0011127_NTC_668
  gRNA
gggccggcacucugucggac

SEQ ID NO: 140349 - RNA, 20 nt, Artificial Sequence
  mmSKRIPTE0011128_NTC_669
  gRNA
gggcgcgucauagacacacg

SEQ ID NO: 140350 - RNA, 20 nt, Artificial Sequence
  mmSKRIPTE0011129_NTC_670
  gRNA
gggcgggacguaauauuaug

SEQ ID NO: 140351 - RNA, 20 nt, Artificial Sequence
  mmSKRIPTE0011130_NTC_671
  gRNA
gggcuagugcguuguuacga

SEQ ID NO: 140352 - RNA, 20 nt, Artificial Sequence
  mmSKRIPTE0011131_NTC_672
  gRNA
ggggauggccuuacgucgcg

SEQ ID NO: 140353 - RNA, 20 nt, Artificial Sequence
  mmSKRIPTE0011132_NTC_673
  gRNA
ggggggucuaauaccgauug

SEQ ID NO: 140354 - RNA, 20 nt, Artificial Sequence
  mmSKRIPTE0011133_NTC_674
  gRNA
gggguaggccuaauuacgga

SEQ ID NO: 140355 - RNA, 20 nt, Artificial Sequence
  mmSKRIPTE0011134_NTC_675
  gRNA
gggguuggauacgcgauuua

SEQ ID NO: 140356 - RNA, 20 nt, Artificial Sequence
  mmSKRIPTE0011135_NTC_676
  gRNA
ggguagcaccccgccgacac

SEQ ID NO: 140357 - RNA, 20 nt, Artificial Sequence
  mmSKRIPTE0011136_NTC_677
  gRNA
gggucgcaccccaauagcug

SEQ ID NO: 140358 - RNA, 20 nt, Artificial Sequence
  mmSKRIPTE0011137_NTC_678
  gRNA
gggugcacacgccggccuau

SEQ ID NO: 140359 - RNA, 20 nt, Artificial Sequence
  mmSKRIPTE0011138_NTC_679
  gRNA
gguaaaaagcguaacgagua

SEQ ID NO: 140360 - RNA, 20 nt, Artificial Sequence
  mmSKRIPTE0011139_NTC_680
  gRNA
gguaacauaggcggcgaucu

SEQ ID NO: 140361 - RNA, 20 nt, Artificial Sequence
  mmSKRIPTE0011140_NTC_681
  gRNA
ggucaaagcgauguuagccg

SEQ ID NO: 140362 - RNA, 20 nt, Artificial Sequence
  mmSKRIPTE0011141_NTC_682
  gRNA
ggucgcucgauuucauuuaa

SEQ ID NO: 140363 - RNA, 20 nt, Artificial Sequence
  mmSKRIPTE0011142_NTC_683
  gRNA
ggucuagauaaucuuaccga

SEQ ID NO: 140364 - RNA, 20 nt, Artificial Sequence
  mmSKRIPTE0011143_NTC_684
  gRNA
ggucucguaauguccuauau

SEQ ID NO: 140365 - RNA, 20 nt, Artificial Sequence
  mmSKRIPTE0011144_NTC_685
  gRNA
ggucuguccguugcgaccac

SEQ ID NO: 140366 - RNA, 20 nt, Artificial Sequence
  mmSKRIPTE0011145_NTC_686
  gRNA
ggugcaguccguuuagucgg

SEQ ID NO: 140367 - RNA, 20 nt, Artificial Sequence
  mmSKRIPTE0011146_NTC_687
  gRNA
gguguggaccgcuuuuacgc

SEQ ID NO: 140368 - RNA, 20 nt, Artificial Sequence
  mmSKRIPTE0011147_NTC_688
  gRNA
gguuaaaaauuaagcggucc

SEQ ID NO: 140369 - RNA, 20 nt, Artificial Sequence
  mmSKRIPTE0011148_NTC_689
  gRNA
guacaugcggcaagucgacu

SEQ ID NO: 140370 - RNA, 20 nt, Artificial Sequence
  mmSKRIPTE0011149_NTC_690
  gRNA
guaccacuuaucgaccuugc

SEQ ID NO: 140371 - RNA, 20 nt, Artificial Sequence
  mmSKRIPTE0011150_NTC_691
  gRNA
guaccaugauaaccguacua

SEQ ID NO: 140372 - RNA, 20 nt, Artificial Sequence
  mmSKRIPTE0011151_NTC_692
  gRNA
guacgcaggguguagcgacc

SEQ ID NO: 140373 - RNA, 20 nt, Artificial Sequence
  mmSKRIPTE0011152_NTC_693
  gRNA
guacugacguuacguucaua

SEQ ID NO: 140374 - RNA, 20 nt, Artificial Sequence
  mmSKRIPTE0011153_NTC_694
  gRNA
guagacauauugcguaaucg

SEQ ID NO: 140375 - RNA, 20 nt, Artificial Sequence
  mmSKRIPTE0011154_NTC_695
  gRNA
guagcugaccgcuuaacuaa

SEQ ID NO: 140376 - RNA, 20 nt, Artificial Sequence
  mmSKRIPTE0011155_NTC_696
  gRNA
guagcuucauguccggucgg

SEQ ID NO: 140377 - RNA, 20 nt, Artificial Sequence
  mmSKRIPTE0011156_NTC_697
  gRNA
guaggccgcugaucgaauaa

SEQ ID NO: 140378 - RNA, 20 nt, Artificial Sequence
  mmSKRIPTE0011157_NTC_698
  gRNA
guagugcgugugaugucggg

SEQ ID NO: 140379 - RNA, 20 nt, Artificial Sequence
  mmSKRIPTE0011158_NTC_699
  gRNA
guauccuccuuacggcccgu

SEQ ID NO: 140380 - RNA, 20 nt, Artificial Sequence
  mmSKRIPTE0011159_NTC_700
  gRNA
guauccucgcaaucguuagg

SEQ ID NO: 140381 - RNA, 20 nt, Artificial Sequence
  mmSKRIPTE0011160_NTC_701
  gRNA
gucaagccgaacgcugccgg

SEQ ID NO: 140382 - RNA, 20 nt, Artificial Sequence
  mmSKRIPTE0011161_NTC_702
  gRNA
gucacaaaaaacgagcguua

SEQ ID NO: 140383 - RNA, 20 nt, Artificial Sequence
  mmSKRIPTE0011162_NTC_703
  gRNA
guccuagauccuaucgggag

SEQ ID NO: 140384 - RNA, 20 nt, Artificial Sequence
  mmSKRIPTE0011163_NTC_704
  gRNA
gucgauuagaugaugcccgg

SEQ ID NO: 140385 - RNA, 20 nt, Artificial Sequence
  mmSKRIPTE0011164_NTC_705
  gRNA
gucgcguauccugacgacac

SEQ ID NO: 140386 - RNA, 20 nt, Artificial Sequence
  mmSKRIPTE0011165_NTC_706
  gRNA
gucgcucgaacucacguagc

SEQ ID NO: 140387 - RNA, 20 nt, Artificial Sequence
  mmSKRIPTE0011166_NTC_707
  gRNA
gucggccgcuuaacccuuuc

SEQ ID NO: 140388 - RNA, 20 nt, Artificial Sequence
  mmSKRIPTE0011167_NTC_708
  gRNA
gucggcucaucggaaaauau

SEQ ID NO: 140389 - RNA, 20 nt, Artificial Sequence
  mmSKRIPTE0011168_NTC_709
  gRNA
gucguggggcacgaugcgua

SEQ ID NO: 140390 - RNA, 20 nt, Artificial Sequence
  mmSKRIPTE0011169_NTC_710
  gRNA
gucguuaacgacccggauuc

SEQ ID NO: 140391 - RNA, 20 nt, Artificial Sequence
  mmSKRIPTE0011170_NTC_711
  gRNA
gucuaacaucggcgcacgug

SEQ ID NO: 140392 - RNA, 20 nt, Artificial Sequence
  mmSKRIPTE0011171_NTC_712
  gRNA
gugauggccacguccgaacc

SEQ ID NO: 140393 - RNA, 20 nt, Artificial Sequence
  mmSKRIPTE0011172_NTC_713
  gRNA
gugcaacgacugacccgcgg

SEQ ID NO: 140394 - RNA, 20 nt, Artificial Sequence
  mmSKRIPTE0011173_NTC_714
  gRNA
gugccagcgucgauugacgc

SEQ ID NO: 140395 - RNA, 20 nt, Artificial Sequence
  mmSKRIPTE0011174_NTC_715
  gRNA
gugccugauagugugaagcg

SEQ ID NO: 140396 - RNA, 20 nt, Artificial Sequence
  mmSKRIPTE0011175_NTC_716
  gRNA
gugcgaauuaaccguuagga

SEQ ID NO: 140397 - RNA, 20 nt, Artificial Sequence
  mmSKRIPTE0011176_NTC_717
  gRNA
gugcgcgcguauagaaaaaa

SEQ ID NO: 140398 - RNA, 20 nt, Artificial Sequence
  mmSKRIPTE0011177_NTC_718
  gRNA
gugggcugaccguucucgac

SEQ ID NO: 140399 - RNA, 20 nt, Artificial Sequence
  mmSKRIPTE0011178_NTC_719
  gRNA
gugguuacguuaacgacuac

SEQ ID NO: 140400 - RNA, 20 nt, Artificial Sequence
  mmSKRIPTE0011179_NTC_720
  gRNA
guguaugacgagaagcgaag

SEQ ID NO: 140401 - RNA, 20 nt, Artificial Sequence
  mmSKRIPTE0011180_NTC_721
  gRNA
gugucuuucggucuuacgag

SEQ ID NO: 140402 - RNA, 20 nt, Artificial Sequence
  mmSKRIPTE0011181_NTC_722
  gRNA
gugugccucgacagcguaag

SEQ ID NO: 140403 - RNA, 20 nt, Artificial Sequence
  mmSKRIPTE0011182_NTC_723
  gRNA
gugugguauauccccguuuu

SEQ ID NO: 140404 - RNA, 20 nt, Artificial Sequence
  mmSKRIPTE0011183_NTC_724
  gRNA
guguuguccgagaacccgac

SEQ ID NO: 140405 - RNA, 20 nt, Artificial Sequence
  mmSKRIPTE0011184_NTC_725
  gRNA
guuaaguagaucggugacau

SEQ ID NO: 140406 - RNA, 20 nt, Artificial Sequence
  mmSKRIPTE0011185_NTC_726
  gRNA
guuaauauuguggcccgcac

SEQ ID NO: 140407 - RNA, 20 nt, Artificial Sequence
  mmSKRIPTE0011186_NTC_727
  gRNA
guuaccccuuuggccggaag

SEQ ID NO: 140408 - RNA, 20 nt, Artificial Sequence
  mmSKRIPTE0011187_NTC_728
  gRNA
guuaccgugacgauaagaau

SEQ ID NO: 140409 - RNA, 20 nt, Artificial Sequence
  mmSKRIPTE0011188_NTC_729
  gRNA
guuacuuaccugaccggcaa

SEQ ID NO: 140410 - RNA, 20 nt, Artificial Sequence
  mmSKRIPTE0011189_NTC_730
  gRNA
guuauaccaccuacuaugac

SEQ ID NO: 140411 - RNA, 20 nt, Artificial Sequence
  mmSKRIPTE0011190_NTC_731
  gRNA
guuauugcgccuuggccgua

SEQ ID NO: 140412 - RNA, 20 nt, Artificial Sequence
  mmSKRIPTE0011191_NTC_732
  gRNA
guuauuugucugucgaaacg

SEQ ID NO: 140413 - RNA, 20 nt, Artificial Sequence
  mmSKRIPTE0011192_NTC_733
  gRNA
guuccggauauauacgguua

SEQ ID NO: 140414 - RNA, 20 nt, Artificial Sequence
  mmSKRIPTE0011193_NTC_734
  gRNA
guucgcgggggcuucuauca

SEQ ID NO: 140415 - RNA, 20 nt, Artificial Sequence
  mmSKRIPTE0011194_NTC_735
  gRNA
guucgguugcagcuuacacg

SEQ ID NO: 140416 - RNA, 20 nt, Artificial Sequence
  mmSKRIPTE0011195_NTC_736
  gRNA
guucuucaaagacgggcggc

SEQ ID NO: 140417 - RNA, 20 nt, Artificial Sequence
  mmSKRIPTE0011196_NTC_737
  gRNA
guugcggcgaccuagauauc

SEQ ID NO: 140418 - RNA, 20 nt, Artificial Sequence
  mmSKRIPTE0011197_NTC_738
  gRNA
guugcguccauuccgucgcc

SEQ ID NO: 140419 - RNA, 20 nt, Artificial Sequence
  mmSKRIPTE0011198_NTC_739
  gRNA
guugcguguguccguacaaa

SEQ ID NO: 140420 - RNA, 20 nt, Artificial Sequence
  mmSKRIPTE0011199_NTC_740
  gRNA
guuucagcgcgaguugcgcg

SEQ ID NO: 140421 - RNA, 20 nt, Artificial Sequence
  mmSKRIPTE0011200_NTC_741
  gRNA
guuucaggaacgacggcgag

SEQ ID NO: 140422 - RNA, 20 nt, Artificial Sequence
  mmSKRIPTE0011201_NTC_742
  gRNA
guuucccgggacugucgcgu

SEQ ID NO: 140423 - RNA, 20 nt, Artificial Sequence
  mmSKRIPTE0011202_NTC_743
  gRNA
guuugcgagucaaaguacgc

SEQ ID NO: 140424 - RNA, 20 nt, Artificial Sequence
  mmSKRIPTE0011203_NTC_744
  gRNA
uaaaaacgcuggcggccuag

SEQ ID NO: 140425 - RNA, 20 nt, Artificial Sequence
  mmSKRIPTE0011204_NTC_745
  gRNA
uaaaaccgaucacgauacga

SEQ ID NO: 140426 - RNA, 20 nt, Artificial Sequence
  mmSKRIPTE0011205_NTC_746
  gRNA
uaaaaguggugcgucgucgu

SEQ ID NO: 140427 - RNA, 20 nt, Artificial Sequence
  mmSKRIPTE0011206_NTC_747
  gRNA
uaaacgauucaccgauaaca

SEQ ID NO: 140428 - RNA, 20 nt, Artificial Sequence
  mmSKRIPTE0011207_NTC_748
  gRNA
uaacacgcacucacguccgg

SEQ ID NO: 140429 - RNA, 20 nt, Artificial Sequence
  mmSKRIPTE0011208_NTC_749
  gRNA
uaacagcuuccgcguaauau

SEQ ID NO: 140430 - RNA, 20 nt, Artificial Sequence
  mmSKRIPTE0011209_NTC_750
  gRNA
uaacccuugaucaaccgaua

SEQ ID NO: 140431 - RNA, 20 nt, Artificial Sequence
  mmSKRIPTE0011210_NTC_751
  gRNA
uaacguuaugucaaacgcuc

SEQ ID NO: 140432 - RNA, 20 nt, Artificial Sequence
  mmSKRIPTE0011211_NTC_752
  gRNA
uaacucuaaugcguuccaag

SEQ ID NO: 140433 - RNA, 20 nt, Artificial Sequence
  mmSKRIPTE0011212_NTC_753
  gRNA
uaagacugggugucccgcgu

SEQ ID NO: 140434 - RNA, 20 nt, Artificial Sequence
  mmSKRIPTE0011213_NTC_754
  gRNA
uaagcggcgucaugucgccc

SEQ ID NO: 140435 - RNA, 20 nt, Artificial Sequence
  mmSKRIPTE0011214_NTC_755
  gRNA
uaagugacacuucguaucgu

SEQ ID NO: 140436 - RNA, 20 nt, Artificial Sequence
  mmSKRIPTE0011215_NTC_756
  gRNA
uaauaaacuaugucccgccg

SEQ ID NO: 140437 - RNA, 20 nt, Artificial Sequence
  mmSKRIPTE0011216_NTC_757
  gRNA
uaaugaguaacgcucaucgg

SEQ ID NO: 140438 - RNA, 20 nt, Artificial Sequence
  mmSKRIPTE0011217_NTC_758
  gRNA
uaaugcgaaugcgaccucuc

SEQ ID NO: 140439 - RNA, 20 nt, Artificial Sequence
  mmSKRIPTE0011218_NTC_759
  gRNA
uaauggaagaugcgcgauac

SEQ ID NO: 140440 - RNA, 20 nt, Artificial Sequence
  mmSKRIPTE0011219_NTC_760
  gRNA
uaauggcacuuaccgggucu

SEQ ID NO: 140441 - RNA, 20 nt, Artificial Sequence
  mmSKRIPTE0011220_NTC_761
  gRNA
uaauucgcaacucggaucau

SEQ ID NO: 140442 - RNA, 20 nt, Artificial Sequence
  mmSKRIPTE0011221_NTC_762
  gRNA
uaauucuuuaguacgugcaa

SEQ ID NO: 140443 - RNA, 20 nt, Artificial Sequence
  mmSKRIPTE0011222_NTC_763
  gRNA
uacacgcccuaagcuaguaa

SEQ ID NO: 140444 - RNA, 20 nt, Artificial Sequence
  mmSKRIPTE0011223_NTC_764
  gRNA
uacaguuauacgucgcggug

SEQ ID NO: 140445 - RNA, 20 nt, Artificial Sequence
  mmSKRIPTE0011224_NTC_765
  gRNA
uacaucgaacaaccaaccga

SEQ ID NO: 140446 - RNA, 20 nt, Artificial Sequence
  mmSKRIPTE0011225_NTC_766
  gRNA
uacaugcgguugacacguuc

SEQ ID NO: 140447 - RNA, 20 nt, Artificial Sequence
  mmSKRIPTE0011226_NTC_767
  gRNA
uaccccucugcgaugccggu

SEQ ID NO: 140448 - RNA, 20 nt, Artificial Sequence
  mmSKRIPTE0011227_NTC_768
  gRNA
uaccccuugaggggcgcaua

SEQ ID NO: 140449 - RNA, 20 nt, Artificial Sequence
  mmSKRIPTE0011228_NTC_769
  gRNA
uacgacaucgcaugguaacg

SEQ ID NO: 140450 - RNA, 20 nt, Artificial Sequence
  mmSKRIPTE0011229_NTC_770
  gRNA
uacgacgaggacgcaucgag

SEQ ID NO: 140451 - RNA, 20 nt, Artificial Sequence
  mmSKRIPTE0011230_NTC_771
  gRNA
uacgcucacuucugcgaagg

SEQ ID NO: 140452 - RNA, 20 nt, Artificial Sequence
  mmSKRIPTE0011231_NTC_772
  gRNA
uacggacgucgaauugagca

SEQ ID NO: 140453 - RNA, 20 nt, Artificial Sequence
  mmSKRIPTE0011232_NTC_773
  gRNA
uacgucugcgcaaauagaau

SEQ ID NO: 140454 - RNA, 20 nt, Artificial Sequence
  mmSKRIPTE0011233_NTC_774
  gRNA
uacugcguaccgcaguaagc

SEQ ID NO: 140455 - RNA, 20 nt, Artificial Sequence
  mmSKRIPTE0011234_NTC_775
  gRNA
uacuuaccgaccgacaaacg

SEQ ID NO: 140456 - RNA, 20 nt, Artificial Sequence
  mmSKRIPTE0011235_NTC_776
  gRNA
uacuuagguccgcguaaagc

SEQ ID NO: 140457 - RNA, 20 nt, Artificial Sequence
  mmSKRIPTE0011236_NTC_777
  gRNA
uagacguccaccgacucuga

SEQ ID NO: 140458 - RNA, 20 nt, Artificial Sequence
  mmSKRIPTE0011237_NTC_778
  gRNA
uagagcagauccccucaacg

SEQ ID NO: 140459 - RNA, 20 nt, Artificial Sequence
  mmSKRIPTE0011238_NTC_779
  gRNA
uagauggugcuucugucgcg

SEQ ID NO: 140460 - RNA, 20 nt, Artificial Sequence
  mmSKRIPTE0011239_NTC_780
  gRNA
uagcccgucgaguacucccc

SEQ ID NO: 140461 - RNA, 20 nt, Artificial Sequence
  mmSKRIPTE0011240_NTC_781
  gRNA
uagccgaguucacgccagua

SEQ ID NO: 140462 - RNA, 20 nt, Artificial Sequence
  mmSKRIPTE0011241_NTC_782
  gRNA
uagcuguuuacgccgaccug

SEQ ID NO: 140463 - RNA, 20 nt, Artificial Sequence
  mmSKRIPTE0011242_NTC_783
  gRNA
uaggccgcucaggccgcacu

SEQ ID NO: 140464 - RNA, 20 nt, Artificial Sequence
  mmSKRIPTE0011243_NTC_784
  gRNA
uaggcggacgguuacauaua

SEQ ID NO: 140465 - RNA, 20 nt, Artificial Sequence
  mmSKRIPTE0011244_NTC_785
  gRNA
uaggggugcgcauuagacua

SEQ ID NO: 140466 - RNA, 20 nt, Artificial Sequence
  mmSKRIPTE0011245_NTC_786
  gRNA
uagguggcgcccaaucggac

SEQ ID NO: 140467 - RNA, 20 nt, Artificial Sequence
  mmSKRIPTE0011246_NTC_787
  gRNA
uaguaaaaaauucgcccucc

SEQ ID NO: 140468 - RNA, 20 nt, Artificial Sequence
  mmSKRIPTE0011247_NTC_788
  gRNA
uaguaggccggagcgcaucc

SEQ ID NO: 140469 - RNA, 20 nt, Artificial Sequence
  mmSKRIPTE0011248_NTC_789
  gRNA
uaguagguugaucgcgucgc

SEQ ID NO: 140470 - RNA, 20 nt, Artificial Sequence
  mmSKRIPTE0011249_NTC_790
  gRNA
uagucagucggccuccgugc

SEQ ID NO: 140471 - RNA, 20 nt, Artificial Sequence
  mmSKRIPTE0011250_NTC_791
  gRNA
uaguccuaguuagauucgcg

SEQ ID NO: 140472 - RNA, 20 nt, Artificial Sequence
  mmSKRIPTE0011251_NTC_792
  gRNA
uagugcgaacagucacggcg

SEQ ID NO: 140473 - RNA, 20 nt, Artificial Sequence
  mmSKRIPTE0011252_NTC_793
  gRNA
uaguguugugagcgucguac

SEQ ID NO: 140474 - RNA, 20 nt, Artificial Sequence
  mmSKRIPTE0011253_NTC_794
  gRNA
uaguuaaccguaaagugggc

SEQ ID NO: 140475 - RNA, 20 nt, Artificial Sequence
  mmSKRIPTE0011254_NTC_795
  gRNA
uaguuaucugcaacgcauag

SEQ ID NO: 140476 - RNA, 20 nt, Artificial Sequence
  mmSKRIPTE0011255_NTC_796
  gRNA
uauacucgccugucacagcg

SEQ ID NO: 140477 - RNA, 20 nt, Artificial Sequence
  mmSKRIPTE0011256_NTC_797
  gRNA
uaucccgauccggaaacuag

SEQ ID NO: 140478 - RNA, 20 nt, Artificial Sequence
  mmSKRIPTE0011257_NTC_798
  gRNA
uaucgaacugcacacgcaac

SEQ ID NO: 140479 - RNA, 20 nt, Artificial Sequence
  mmSKRIPTE0011258_NTC_799
  gRNA
uaucuaaucgcggagucgua

SEQ ID NO: 140480 - RNA, 20 nt, Artificial Sequence
  mmSKRIPTE0011259_NTC_800
  gRNA
uaucucuggaugccgucggu

SEQ ID NO: 140481 - RNA, 20 nt, Artificial Sequence
  mmSKRIPTE0011260_NTC_801
  gRNA
uaugaaacaucucggcgacg

SEQ ID NO: 140482 - RNA, 20 nt, Artificial Sequence
  mmSKRIPTE0011261_NTC_802
  gRNA
uaugaaccuccggaucggug

SEQ ID NO: 140483 - RNA, 20 nt, Artificial Sequence
  mmSKRIPTE0011262_NTC_803
  gRNA
uaugaacuaggcguaaacgg

SEQ ID NO: 140484 - RNA, 20 nt, Artificial Sequence
  mmSKRIPTE0011263_NTC_804
  gRNA
uaugacacacaaucugcgac

SEQ ID NO: 140485 - RNA, 20 nt, Artificial Sequence
  mmSKRIPTE0011264_NTC_805
  gRNA
uaugacugcacgacucgcua

SEQ ID NO: 140486 - RNA, 20 nt, Artificial Sequence
  mmSKRIPTE0011265_NTC_806
  gRNA
uaugaucguauggcccuucc

SEQ ID NO: 140487 - RNA, 20 nt, Artificial Sequence
  mmSKRIPTE0011266_NTC_807
  gRNA
uaugccauaugcccguuuuu

SEQ ID NO: 140488 - RNA, 20 nt, Artificial Sequence
  mmSKRIPTE0011267_NTC_808
  gRNA
ucaaacgcccgggcgcccca

SEQ ID NO: 140489 - RNA, 20 nt, Artificial Sequence
  mmSKRIPTE0011268_NTC_809
  gRNA
ucaacuaugaaccgccgugc

SEQ ID NO: 140490 - RNA, 20 nt, Artificial Sequence
  mmSKRIPTE0011269_NTC_810
  gRNA
ucaacuuaaccucgaguccg

SEQ ID NO: 140491 - RNA, 20 nt, Artificial Sequence
  mmSKRIPTE0011270_NTC_811
  gRNA
ucaauaguucugcgcgaauu

SEQ ID NO: 140492 - RNA, 20 nt, Artificial Sequence
  mmSKRIPTE0011271_NTC_812
  gRNA
ucaaucugcggugacucguu

SEQ ID NO: 140493 - RNA, 20 nt, Artificial Sequence
  mmSKRIPTE0011272_NTC_813
  gRNA
ucaauuaguggccgccaagc

SEQ ID NO: 140494 - RNA, 20 nt, Artificial Sequence
  mmSKRIPTE0011273_NTC_814
  gRNA
ucacaacccccgacuaucgc

SEQ ID NO: 140495 - RNA, 20 nt, Artificial Sequence
  mmSKRIPTE0011274_NTC_815
  gRNA
ucacacgggaucucgccggu

SEQ ID NO: 140496 - RNA, 20 nt, Artificial Sequence
  mmSKRIPTE0011275_NTC_816
  gRNA
ucacaugacacucguuacga

SEQ ID NO: 140497 - RNA, 20 nt, Artificial Sequence
  mmSKRIPTE0011276_NTC_817
  gRNA
ucacccgcguauacgaccug

SEQ ID NO: 140498 - RNA, 20 nt, Artificial Sequence
  mmSKRIPTE0011277_NTC_818
  gRNA
ucacgcacgacuaagggaau

SEQ ID NO: 140499 - RNA, 20 nt, Artificial Sequence
  mmSKRIPTE0011278_NTC_819
  gRNA
ucacucaaagugcguagucg

SEQ ID NO: 140500 - RNA, 20 nt, Artificial Sequence
  mmSKRIPTE0011279_NTC_820
  gRNA
ucacuucgggcauuacgagc

SEQ ID NO: 140501 - RNA, 20 nt, Artificial Sequence
  mmSKRIPTE0011280_NTC_821
  gRNA
ucacuuuaagcaccccgcgc

SEQ ID NO: 140502 - RNA, 20 nt, Artificial Sequence
  mmSKRIPTE0011281_NTC_822
  gRNA
ucagcagaauugggcccgua

SEQ ID NO: 140503 - RNA, 20 nt, Artificial Sequence
  mmSKRIPTE0011282_NTC_823
  gRNA
ucagcuacgaucggacccaa

SEQ ID NO: 140504 - RNA, 20 nt, Artificial Sequence
  mmSKRIPTE0011283_NTC_824
  gRNA
ucagucagucggcccccugc

SEQ ID NO: 140505 - RNA, 20 nt, Artificial Sequence
  mmSKRIPTE0011284_NTC_825
  gRNA
ucauauuagacaaucuccgc

SEQ ID NO: 140506 - RNA, 20 nt, Artificial Sequence
  mmSKRIPTE0011285_NTC_826
  gRNA
ucaucuacgguaucgaaagg

SEQ ID NO: 140507 - RNA, 20 nt, Artificial Sequence
  mmSKRIPTE0011286_NTC_827
  gRNA
ucaugcgccucguaauaccu

SEQ ID NO: 140508 - RNA, 20 nt, Artificial Sequence
  mmSKRIPTE0011287_NTC_828
  gRNA
ucauguugcgucguccguua

SEQ ID NO: 140509 - RNA, 20 nt, Artificial Sequence
  mmSKRIPTE0011288_NTC_829
  gRNA
ucccccguacguguaugucg

SEQ ID NO: 140510 - RNA, 20 nt, Artificial Sequence
  mmSKRIPTE0011289_NTC_830
  gRNA
uccccuucgucggcgccagg

SEQ ID NO: 140511 - RNA, 20 nt, Artificial Sequence
  mmSKRIPTE0011290_NTC_831
  gRNA
ucccgggagguacgguguac

SEQ ID NO: 140512 - RNA, 20 nt, Artificial Sequence
  mmSKRIPTE0011291_NTC_832
  gRNA
uccgaacaggcgcguuucuc

SEQ ID NO: 140513 - RNA, 20 nt, Artificial Sequence
  mmSKRIPTE0011292_NTC_833
  gRNA
uccgcggcaacguuuggguc

SEQ ID NO: 140514 - RNA, 20 nt, Artificial Sequence
  mmSKRIPTE0011293_NTC_834
  gRNA
uccguacaucgaccuauuac

SEQ ID NO: 140515 - RNA, 20 nt, Artificial Sequence
  mmSKRIPTE0011294_NTC_835
  gRNA
uccguaggacguauauauuc

SEQ ID NO: 140516 - RNA, 20 nt, Artificial Sequence
  mmSKRIPTE0011295_NTC_836
  gRNA
uccuacaccaccccggccgu

SEQ ID NO: 140517 - RNA, 20 nt, Artificial Sequence
  mmSKRIPTE0011296_NTC_837
  gRNA
uccuaggccugauuuacccg

SEQ ID NO: 140518 - RNA, 20 nt, Artificial Sequence
  mmSKRIPTE0011297_NTC_838
  gRNA
uccuauaauugagcgaacgg

SEQ ID NO: 140519 - RNA, 20 nt, Artificial Sequence
  mmSKRIPTE0011298_NTC_839
  gRNA
uccuccgaucgaccagggua

SEQ ID NO: 140520 - RNA, 20 nt, Artificial Sequence
  mmSKRIPTE0011299_NTC_840
  gRNA
uccugcgcgaugaccgucgg

SEQ ID NO: 140521 - RNA, 20 nt, Artificial Sequence
  mmSKRIPTE0011300_NTC_841
  gRNA
uccugcguuccacucguacu

SEQ ID NO: 140522 - RNA, 20 nt, Artificial Sequence
  mmSKRIPTE0011301_NTC_842
  gRNA
ucgagucuugacucaacgcu

SEQ ID NO: 140523 - RNA, 20 nt, Artificial Sequence
  mmSKRIPTE0011302_NTC_843
  gRNA
ucgaucgucggcggagcgga

SEQ ID NO: 140524 - RNA, 20 nt, Artificial Sequence
  mmSKRIPTE0011303_NTC_844
  gRNA
ucgcaaaaugcggauuccgu

SEQ ID NO: 140525 - RNA, 20 nt, Artificial Sequence
  mmSKRIPTE0011304_NTC_845
  gRNA
ucgcacucuaggccguuauu

SEQ ID NO: 140526 - RNA, 20 nt, Artificial Sequence
  mmSKRIPTE0011305_NTC_846
  gRNA
ucgcgaauugcugccgaacu

SEQ ID NO: 140527 - RNA, 20 nt, Artificial Sequence
  mmSKRIPTE0011306_NTC_847
  gRNA
ucgcuaagccggguaauacu

SEQ ID NO: 140528 - RNA, 20 nt, Artificial Sequence
  mmSKRIPTE0011307_NTC_848
  gRNA
ucgcucauuaggagcgcuau

SEQ ID NO: 140529 - RNA, 20 nt, Artificial Sequence
  mmSKRIPTE0011308_NTC_849
  gRNA
ucgcuccgcuaguagugggu

SEQ ID NO: 140530 - RNA, 20 nt, Artificial Sequence
  mmSKRIPTE0011309_NTC_850
  gRNA
ucgcugagcaacgaagcaac

SEQ ID NO: 140531 - RNA, 20 nt, Artificial Sequence
  mmSKRIPTE0011310_NTC_851
  gRNA
ucgcuucugauugauccacg

SEQ ID NO: 140532 - RNA, 20 nt, Artificial Sequence
  mmSKRIPTE0011311_NTC_852
  gRNA
ucggaauuccgcaggccgag

SEQ ID NO: 140533 - RNA, 20 nt, Artificial Sequence
  mmSKRIPTE0011312_NTC_853
  gRNA
ucggacuauagcgugaacgu

SEQ ID NO: 140534 - RNA, 20 nt, Artificial Sequence
  mmSKRIPTE0011313_NTC_854
  gRNA
ucggaucgguacauaaaguu

SEQ ID NO: 140535 - RNA, 20 nt, Artificial Sequence
  mmSKRIPTE0011314_NTC_855
  gRNA
ucggauuuuaauccuuacgc

SEQ ID NO: 140536 - RNA, 20 nt, Artificial Sequence
  mmSKRIPTE0011315_NTC_856
  gRNA
ucggcgcagccuaauguaua

SEQ ID NO: 140537 - RNA, 20 nt, Artificial Sequence
  mmSKRIPTE0011316_NTC_857
  gRNA
ucguaaagucgcagcgacgu

SEQ ID NO: 140538 - RNA, 20 nt, Artificial Sequence
  mmSKRIPTE0011317_NTC_858
  gRNA
ucguaaguucgcuauaugcc

SEQ ID NO: 140539 - RNA, 20 nt, Artificial Sequence
  mmSKRIPTE0011318_NTC_859
  gRNA
ucguaccgcacguguaagcc

SEQ ID NO: 140540 - RNA, 20 nt, Artificial Sequence
  mmSKRIPTE0011319_NTC_860
  gRNA
ucgugccggaauaaccacua

SEQ ID NO: 140541 - RNA, 20 nt, Artificial Sequence
  mmSKRIPTE0011320_NTC_861
  gRNA
ucgugccuagcucgguugag

SEQ ID NO: 140542 - RNA, 20 nt, Artificial Sequence
  mmSKRIPTE0011321_NTC_862
  gRNA
ucgugucuagcuaucgagug

SEQ ID NO: 140543 - RNA, 20 nt, Artificial Sequence
  mmSKRIPTE0011322_NTC_863
  gRNA
ucguuacauaccccgcggaa

SEQ ID NO: 140544 - RNA, 20 nt, Artificial Sequence
  mmSKRIPTE0011323_NTC_864
  gRNA
ucguugugucgacauccgca

SEQ ID NO: 140545 - RNA, 20 nt, Artificial Sequence
  mmSKRIPTE0011324_NTC_865
  gRNA
ucuacacgcgcguucaaccg

SEQ ID NO: 140546 - RNA, 20 nt, Artificial Sequence
  mmSKRIPTE0011325_NTC_866
  gRNA
ucuaggauacucuuaacggg

SEQ ID NO: 140547 - RNA, 20 nt, Artificial Sequence
  mmSKRIPTE0011326_NTC_867
  gRNA
ucuauaucuagucucggcgc

SEQ ID NO: 140548 - RNA, 20 nt, Artificial Sequence
  mmSKRIPTE0011327_NTC_868
  gRNA
ucucaguucguagcgaacga

SEQ ID NO: 140549 - RNA, 20 nt, Artificial Sequence
  mmSKRIPTE0011328_NTC_869
  gRNA
ucuccgggccguguuagacc

SEQ ID NO: 140550 - RNA, 20 nt, Artificial Sequence
  mmSKRIPTE0011329_NTC_870
  gRNA
ucuccguccgaaacggcgac

SEQ ID NO: 140551 - RNA, 20 nt, Artificial Sequence
  mmSKRIPTE0011330_NTC_871
  gRNA
ucucgaauaaauuuucucgc

SEQ ID NO: 140552 - RNA, 20 nt, Artificial Sequence
  mmSKRIPTE0011331_NTC_872
  gRNA
ucucuucgcgcccgcuuugc

SEQ ID NO: 140553 - RNA, 20 nt, Artificial Sequence
  mmSKRIPTE0011332_NTC_873
  gRNA
ucugcaccgcgacuuagcuu

SEQ ID NO: 140554 - RNA, 20 nt, Artificial Sequence
  mmSKRIPTE0011333_NTC_874
  gRNA
ucuggacgcgagaugacggg

SEQ ID NO: 140555 - RNA, 20 nt, Artificial Sequence
  mmSKRIPTE0011334_NTC_875
  gRNA
ucuucuagugcgaguuccgc

SEQ ID NO: 140556 - RNA, 20 nt, Artificial Sequence
  mmSKRIPTE0011335_NTC_876
  gRNA
ucuucucgagcgugcgggcc

SEQ ID NO: 140557 - RNA, 20 nt, Artificial Sequence
  mmSKRIPTE0011336_NTC_877
  gRNA
ucuugacuccgacuucgggc

SEQ ID NO: 140558 - RNA, 20 nt, Artificial Sequence
  mmSKRIPTE0011337_NTC_878
  gRNA
ugacaaccgcgguaccucua

SEQ ID NO: 140559 - RNA, 20 nt, Artificial Sequence
  mmSKRIPTE0011338_NTC_879
  gRNA
ugacccgucucuucgcgcac

SEQ ID NO: 140560 - RNA, 20 nt, Artificial Sequence
  mmSKRIPTE0011339_NTC_880
  gRNA
ugacccucuuaaucuccggu

SEQ ID NO: 140561 - RNA, 20 nt, Artificial Sequence
  mmSKRIPTE0011340_NTC_881
  gRNA
ugacgcgccucggaccaacc

SEQ ID NO: 140562 - RNA, 20 nt, Artificial Sequence
  mmSKRIPTE0011341_NTC_882
  gRNA
ugacgcuaaggcccgcuaac

SEQ ID NO: 140563 - RNA, 20 nt, Artificial Sequence
  mmSKRIPTE0011342_NTC_883
  gRNA
ugacuugacacguucgauau

SEQ ID NO: 140564 - RNA, 20 nt, Artificial Sequence
  mmSKRIPTE0011343_NTC_884
  gRNA
ugagaccaaugccgcggaau

SEQ ID NO: 140565 - RNA, 20 nt, Artificial Sequence
  mmSKRIPTE0011344_NTC_885
  gRNA
ugagagcaaggcgcauacgc

SEQ ID NO: 140566 - RNA, 20 nt, Artificial Sequence
  mmSKRIPTE0011345_NTC_886
  gRNA
ugagccggugcgcucucggu

SEQ ID NO: 140567 - RNA, 20 nt, Artificial Sequence
  mmSKRIPTE0011346_NTC_887
  gRNA
ugagccuuuguggaccgcgg

SEQ ID NO: 140568 - RNA, 20 nt, Artificial Sequence
  mmSKRIPTE0011347_NTC_888
  gRNA
ugagcgcuuucccgauccgg

SEQ ID NO: 140569 - RNA, 20 nt, Artificial Sequence
  mmSKRIPTE0011348_NTC_889
  gRNA
ugagggcucaauacuuccgc

SEQ ID NO: 140570 - RNA, 20 nt, Artificial Sequence
  mmSKRIPTE0011349_NTC_890
  gRNA
ugagguuaccgccggcuuuu

SEQ ID NO: 140571 - RNA, 20 nt, Artificial Sequence
  mmSKRIPTE0011350_NTC_891
  gRNA
ugauaaacgaugcgaacucg

SEQ ID NO: 140572 - RNA, 20 nt, Artificial Sequence
  mmSKRIPTE0011351_NTC_892
  gRNA
ugaucaacgucgguggacgg

SEQ ID NO: 140573 - RNA, 20 nt, Artificial Sequence
  mmSKRIPTE0011352_NTC_893
  gRNA
ugauccccgucccgaaguua

SEQ ID NO: 140574 - RNA, 20 nt, Artificial Sequence
  mmSKRIPTE0011353_NTC_894
  gRNA
ugaugccgguacccguaacu

SEQ ID NO: 140575 - RNA, 20 nt, Artificial Sequence
  mmSKRIPTE0011354_NTC_895
  gRNA
ugauggacgcgauacguuua

SEQ ID NO: 140576 - RNA, 20 nt, Artificial Sequence
  mmSKRIPTE0011355_NTC_896
  gRNA
ugauugggggucguucgcca

SEQ ID NO: 140577 - RNA, 20 nt, Artificial Sequence
  mmSKRIPTE0011356_NTC_897
  gRNA
ugcaacgaugguuacgguac

SEQ ID NO: 140578 - RNA, 20 nt, Artificial Sequence
  mmSKRIPTE0011357_NTC_898
  gRNA
ugcaccgguacgggcgacuc

SEQ ID NO: 140579 - RNA, 20 nt, Artificial Sequence
  mmSKRIPTE0011358_NTC_899
  gRNA
ugcagaucgcgaagcgacua

SEQ ID NO: 140580 - RNA, 20 nt, Artificial Sequence
  mmSKRIPTE0011359_NTC_900
  gRNA
ugcaguagucgcggauaggc

SEQ ID NO: 140581 - RNA, 20 nt, Artificial Sequence
  mmSKRIPTE0011360_NTC_901
  gRNA
ugcccugcguccgcuacguc

SEQ ID NO: 140582 - RNA, 20 nt, Artificial Sequence
  mmSKRIPTE0011361_NTC_902
  gRNA
ugccgacgcgacgcagcgua

SEQ ID NO: 140583 - RNA, 20 nt, Artificial Sequence
  mmSKRIPTE0011362_NTC_903
  gRNA
ugccuacugucguucccgcg

SEQ ID NO: 140584 - RNA, 20 nt, Artificial Sequence
  mmSKRIPTE0011363_NTC_904
  gRNA
ugccuucagucgaccguuac

SEQ ID NO: 140585 - RNA, 20 nt, Artificial Sequence
  mmSKRIPTE0011364_NTC_905
  gRNA
ugcgcguccuguuaugaccg

SEQ ID NO: 140586 - RNA, 20 nt, Artificial Sequence
  mmSKRIPTE0011365_NTC_906
  gRNA
ugcggcaauguuaacccuua

SEQ ID NO: 140587 - RNA, 20 nt, Artificial Sequence
  mmSKRIPTE0011366_NTC_907
  gRNA
ugcguaaaacuugcgcucga

SEQ ID NO: 140588 - RNA, 20 nt, Artificial Sequence
  mmSKRIPTE0011367_NTC_908
  gRNA
ugcgucucagcuucggcuau

SEQ ID NO: 140589 - RNA, 20 nt, Artificial Sequence
  mmSKRIPTE0011368_NTC_909
  gRNA
ugcuggccgauacgugcuug

SEQ ID NO: 140590 - RNA, 20 nt, Artificial Sequence
  mmSKRIPTE0011369_NTC_910
  gRNA
ugcuuagggcccuucggcgg

SEQ ID NO: 140591 - RNA, 20 nt, Artificial Sequence
  mmSKRIPTE0011370_NTC_911
  gRNA
ugcuuuaccgcguuggguaa

SEQ ID NO: 140592 - RNA, 20 nt, Artificial Sequence
  mmSKRIPTE0011371_NTC_912
  gRNA
uggauccgcuucgcacggcg

SEQ ID NO: 140593 - RNA, 20 nt, Artificial Sequence
  mmSKRIPTE0011372_NTC_913
  gRNA
uggcacggaguugcauacgc

SEQ ID NO: 140594 - RNA, 20 nt, Artificial Sequence
  mmSKRIPTE0011373_NTC_914
  gRNA
uggcccacaaggugcgauau

SEQ ID NO: 140595 - RNA, 20 nt, Artificial Sequence
  mmSKRIPTE0011374_NTC_915
  gRNA
uggcgcuccugcgcacacga

SEQ ID NO: 140596 - RNA, 20 nt, Artificial Sequence
  mmSKRIPTE0011375_NTC_916
  gRNA
uggcuuaauggacagcgcga

SEQ ID NO: 140597 - RNA, 20 nt, Artificial Sequence
  mmSKRIPTE0011376_NTC_917
  gRNA
ugggccauaguggcgcguga

SEQ ID NO: 140598 - RNA, 20 nt, Artificial Sequence
  mmSKRIPTE0011377_NTC_918
  gRNA
ugggcgguucaaagcgaauu

SEQ ID NO: 140599 - RNA, 20 nt, Artificial Sequence
  mmSKRIPTE0011378_NTC_919
  gRNA
uggguccuaaacgcgguuca

SEQ ID NO: 140600 - RNA, 20 nt, Artificial Sequence
  mmSKRIPTE0011379_NTC_920
  gRNA
uggguuccggccccauguac

SEQ ID NO: 140601 - RNA, 20 nt, Artificial Sequence
  mmSKRIPTE0011380_NTC_921
  gRNA
ugguaccacucgccgaaucu

SEQ ID NO: 140602 - RNA, 20 nt, Artificial Sequence
  mmSKRIPTE0011381_NTC_922
  gRNA
ugguucaccacucgagaucg

SEQ ID NO: 140603 - RNA, 20 nt, Artificial Sequence
  mmSKRIPTE0011382_NTC_923
  gRNA
ugguucgaccaacaugguuc

SEQ ID NO: 140604 - RNA, 20 nt, Artificial Sequence
  mmSKRIPTE0011383_NTC_924
  gRNA
ugguuggcaugucgccagcg

SEQ ID NO: 140605 - RNA, 20 nt, Artificial Sequence
  mmSKRIPTE0011384_NTC_925
  gRNA
uguaacgaucugggcggucu

SEQ ID NO: 140606 - RNA, 20 nt, Artificial Sequence
  mmSKRIPTE0011385_NTC_926
  gRNA
uguacucgcauagcgggggc

SEQ ID NO: 140607 - RNA, 20 nt, Artificial Sequence
  mmSKRIPTE0011386_NTC_927
  gRNA
uguauagucaucgccguaau

SEQ ID NO: 140608 - RNA, 20 nt, Artificial Sequence
  mmSKRIPTE0011387_NTC_928
  gRNA
uguauccaccgugacccggu

SEQ ID NO: 140609 - RNA, 20 nt, Artificial Sequence
  mmSKRIPTE0011388_NTC_929
  gRNA
ugucccgacgauguguaaau

SEQ ID NO: 140610 - RNA, 20 nt, Artificial Sequence
  mmSKRIPTE0011389_NTC_930
  gRNA
uguccuaccgaaugaaccgu

SEQ ID NO: 140611 - RNA, 20 nt, Artificial Sequence
  mmSKRIPTE0011390_NTC_931
  gRNA
ugucgccgauggucagucgc

SEQ ID NO: 140612 - RNA, 20 nt, Artificial Sequence
  mmSKRIPTE0011391_NTC_932
  gRNA
ugucggacccauugucgaac

SEQ ID NO: 140613 - RNA, 20 nt, Artificial Sequence
  mmSKRIPTE0011392_NTC_933
  gRNA
ugucuauguuuggccacgca

SEQ ID NO: 140614 - RNA, 20 nt, Artificial Sequence
  mmSKRIPTE0011393_NTC_934
  gRNA
ugucugccgcauacgcuaua

SEQ ID NO: 140615 - RNA, 20 nt, Artificial Sequence
  mmSKRIPTE0011394_NTC_935
  gRNA
ugugccacgccgcugcaacg

SEQ ID NO: 140616 - RNA, 20 nt, Artificial Sequence
  mmSKRIPTE0011395_NTC_936
  gRNA
ugugccuacgccauucggcu

SEQ ID NO: 140617 - RNA, 20 nt, Artificial Sequence
  mmSKRIPTE0011396_NTC_937
  gRNA
uguguaauuacguuucgcgg

SEQ ID NO: 140618 - RNA, 20 nt, Artificial Sequence
  mmSKRIPTE0011397_NTC_938
  gRNA
uguuaaugccaacgggacau

SEQ ID NO: 140619 - RNA, 20 nt, Artificial Sequence
  mmSKRIPTE0011398_NTC_939
  gRNA
uguucgcccucucacgauug

SEQ ID NO: 140620 - RNA, 20 nt, Artificial Sequence
  mmSKRIPTE0011399_NTC_940
  gRNA
uguuuaugcggaacuuccgc

SEQ ID NO: 140621 - RNA, 20 nt, Artificial Sequence
  mmSKRIPTE0011400_NTC_941
  gRNA
uuaacgucugugcgcacuac

SEQ ID NO: 140622 - RNA, 20 nt, Artificial Sequence
  mmSKRIPTE0011401_NTC_942
  gRNA
uuaacuggggggaccggacg

SEQ ID NO: 140623 - RNA, 20 nt, Artificial Sequence
  mmSKRIPTE0011402_NTC_943
  gRNA
uuacaguucauaccgucgcc

SEQ ID NO: 140624 - RNA, 20 nt, Artificial Sequence
  mmSKRIPTE0011403_NTC_944
  gRNA
uuaccgugguacgucagguu

SEQ ID NO: 140625 - RNA, 20 nt, Artificial Sequence
  mmSKRIPTE0011404_NTC_945
  gRNA
uuacgcaaagcugcgaugag

SEQ ID NO: 140626 - RNA, 20 nt, Artificial Sequence
  mmSKRIPTE0011405_NTC_946
  gRNA
uuacugaucagucggacgca

SEQ ID NO: 140627 - RNA, 20 nt, Artificial Sequence
  mmSKRIPTE0011406_NTC_947
  gRNA
uuacuuggugcaacaaccgg

SEQ ID NO: 140628 - RNA, 20 nt, Artificial Sequence
  mmSKRIPTE0011407_NTC_948
  gRNA
uuagccuugccccgucauac

SEQ ID NO: 140629 - RNA, 20 nt, Artificial Sequence
  mmSKRIPTE0011408_NTC_949
  gRNA
uuaggacgugcuuccgaggg

SEQ ID NO: 140630 - RNA, 20 nt, Artificial Sequence
  mmSKRIPTE0011409_NTC_950
  gRNA
uuaguucgaccacuccugau

SEQ ID NO: 140631 - RNA, 20 nt, Artificial Sequence
  mmSKRIPTE0011410_NTC_951
  gRNA
uuauaccgucacgagugccc

SEQ ID NO: 140632 - RNA, 20 nt, Artificial Sequence
  mmSKRIPTE0011411_NTC_952
  gRNA
uuaucgcacaaccccgaaag

SEQ ID NO: 140633 - RNA, 20 nt, Artificial Sequence
  mmSKRIPTE0011412_NTC_953
  gRNA
uuaucguacuaguacguaca

SEQ ID NO: 140634 - RNA, 20 nt, Artificial Sequence
  mmSKRIPTE0011413_NTC_954
  gRNA
uuaugaccucgaugcgacau

SEQ ID NO: 140635 - RNA, 20 nt, Artificial Sequence
  mmSKRIPTE0011414_NTC_955
  gRNA
uuaugugccucucggcgcau

SEQ ID NO: 140636 - RNA, 20 nt, Artificial Sequence
  mmSKRIPTE0011415_NTC_956
  gRNA
uuauugguuucaacgguugu

SEQ ID NO: 140637 - RNA, 20 nt, Artificial Sequence
  mmSKRIPTE0011416_NTC_957
  gRNA
uuauuuacgcgcugaacuug

SEQ ID NO: 140638 - RNA, 20 nt, Artificial Sequence
  mmSKRIPTE0011417_NTC_958
  gRNA
uucaacgacggaagacgcgc

SEQ ID NO: 140639 - RNA, 20 nt, Artificial Sequence
  mmSKRIPTE0011418_NTC_959
  gRNA
uucaaguguuauggacgcgc

SEQ ID NO: 140640 - RNA, 20 nt, Artificial Sequence
  mmSKRIPTE0011419_NTC_960
  gRNA
uucaauuguucgcccgaaca

SEQ ID NO: 140641 - RNA, 20 nt, Artificial Sequence
  mmSKRIPTE0011420_NTC_961
  gRNA
uucauccuucguagcgcagc

SEQ ID NO: 140642 - RNA, 20 nt, Artificial Sequence
  mmSKRIPTE0011421_NTC_962
  gRNA
uucaucgcagaucgauuucg

SEQ ID NO: 140643 - RNA, 20 nt, Artificial Sequence
  mmSKRIPTE0011422_NTC_963
  gRNA
uuccaguauaccgaauucgc

SEQ ID NO: 140644 - RNA, 20 nt, Artificial Sequence
  mmSKRIPTE0011423_NTC_964
  gRNA
uuccccgcccgugcggucau

SEQ ID NO: 140645 - RNA, 20 nt, Artificial Sequence
  mmSKRIPTE0011424_NTC_965
  gRNA
uucgaagucuaacccgcggg

SEQ ID NO: 140646 - RNA, 20 nt, Artificial Sequence
  mmSKRIPTE0011425_NTC_966
  gRNA
uucgacgugcggcguauugg

SEQ ID NO: 140647 - RNA, 20 nt, Artificial Sequence
  mmSKRIPTE0011426_NTC_967
  gRNA
uucgacugcgcacgccauga

SEQ ID NO: 140648 - RNA, 20 nt, Artificial Sequence
  mmSKRIPTE0011427_NTC_968
  gRNA
uucgagacggauacgucugc

SEQ ID NO: 140649 - RNA, 20 nt, Artificial Sequence
  mmSKRIPTE0011428_NTC_969
  gRNA
uucgagauuuuaauagcgca

SEQ ID NO: 140650 - RNA, 20 nt, Artificial Sequence
  mmSKRIPTE0011429_NTC_970
  gRNA
uucgauauaggggacggcgg

SEQ ID NO: 140651 - RNA, 20 nt, Artificial Sequence
  mmSKRIPTE0011430_NTC_971
  gRNA
uucgccggcgacgaagugca

SEQ ID NO: 140652 - RNA, 20 nt, Artificial Sequence
  mmSKRIPTE0011431_NTC_972
  gRNA
uucgcgaguaagguaggcau

SEQ ID NO: 140653 - RNA, 20 nt, Artificial Sequence
  mmSKRIPTE0011432_NTC_973
  gRNA
uucggcucaauggcgcgagc

SEQ ID NO: 140654 - RNA, 20 nt, Artificial Sequence
  mmSKRIPTE0011433_NTC_974
  gRNA
uucggcuggugugcguucac

SEQ ID NO: 140655 - RNA, 20 nt, Artificial Sequence
  mmSKRIPTE0011434_NTC_975
  gRNA
uucguggccgaaggcgccgc

SEQ ID NO: 140656 - RNA, 20 nt, Artificial Sequence
  mmSKRIPTE0011435_NTC_976
  gRNA
uucuccauaccguaacuccg

SEQ ID NO: 140657 - RNA, 20 nt, Artificial Sequence
  mmSKRIPTE0011436_NTC_977
  gRNA
uucugauuagauacguacga

SEQ ID NO: 140658 - RNA, 20 nt, Artificial Sequence
  mmSKRIPTE0011437_NTC_978
  gRNA
uugaacacgacacccgugcc

SEQ ID NO: 140659 - RNA, 20 nt, Artificial Sequence
  mmSKRIPTE0011438_NTC_979
  gRNA
uugaaguagggucggauuga

SEQ ID NO: 140660 - RNA, 20 nt, Artificial Sequence
  mmSKRIPTE0011439_NTC_980
  gRNA
uugaauccgaggcgccgaug

SEQ ID NO: 140661 - RNA, 20 nt, Artificial Sequence
  mmSKRIPTE0011440_NTC_981
  gRNA
uugagcggaccccccuacaa

SEQ ID NO: 140662 - RNA, 20 nt, Artificial Sequence
  mmSKRIPTE0011441_NTC_982
  gRNA
uugauaaaccgcggccgaaa

SEQ ID NO: 140663 - RNA, 20 nt, Artificial Sequence
  mmSKRIPTE0011442_NTC_983
  gRNA
uugcacccccaguucguugc

SEQ ID NO: 140664 - RNA, 20 nt, Artificial Sequence
  mmSKRIPTE0011443_NTC_984
  gRNA
uugcagcaacggcgacggcu

SEQ ID NO: 140665 - RNA, 20 nt, Artificial Sequence
  mmSKRIPTE0011444_NTC_985
  gRNA
uugcgugugcguuguuaacg

SEQ ID NO: 140666 - RNA, 20 nt, Artificial Sequence
  mmSKRIPTE0011445_NTC_986
  gRNA
uuggacguacacuuucguuc

SEQ ID NO: 140667 - RNA, 20 nt, Artificial Sequence
  mmSKRIPTE0011446_NTC_987
  gRNA
uuggcggcucgcuccugcgu

SEQ ID NO: 140668 - RNA, 20 nt, Artificial Sequence
  mmSKRIPTE0011447_NTC_988
  gRNA
uugucaacuucggccaacgc

SEQ ID NO: 140669 - RNA, 20 nt, Artificial Sequence
  mmSKRIPTE0011448_NTC_989
  gRNA
uugucgcuaacucagaauag

SEQ ID NO: 140670 - RNA, 20 nt, Artificial Sequence
  mmSKRIPTE0011449_NTC_990
  gRNA
uuguuucagccuugagcgcg

SEQ ID NO: 140671 - RNA, 20 nt, Artificial Sequence
  mmSKRIPTE0011450_NTC_991
  gRNA
uuuacguaugcugugcgcga

SEQ ID NO: 140672 - RNA, 20 nt, Artificial Sequence
  mmSKRIPTE0011451_NTC_992
  gRNA
uuuagucagacgagccggau

SEQ ID NO: 140673 - RNA, 20 nt, Artificial Sequence
  mmSKRIPTE0011452_NTC_993
  gRNA
uuucaguugucgcgcgacuc

SEQ ID NO: 140674 - RNA, 20 nt, Artificial Sequence
  mmSKRIPTE0011453_NTC_994
  gRNA
uuucuaauuacccgauacgu

SEQ ID NO: 140675 - RNA, 20 nt, Artificial Sequence
  mmSKRIPTE0011454_NTC_995
  gRNA
uuucuagggccgccgcccgc

SEQ ID NO: 140676 - RNA, 20 nt, Artificial Sequence
  mmSKRIPTE0011455_NTC_996
  gRNA
uuugacauuuucgucucgcg

SEQ ID NO: 140677 - RNA, 20 nt, Artificial Sequence
  mmSKRIPTE0011456_NTC_997
  gRNA
uuuuaguaggucaacgcugu

SEQ ID NO: 140678 - RNA, 20 nt, Artificial Sequence
  mmSKRIPTE0011457_NTC_998
  gRNA
uuuucgucgacuaagucaag

SEQ ID NO: 140679 - RNA, 20 nt, Artificial Sequence
  mmSKRIPTE0011458_NTC_999
  gRNA
uuuuggcgacgcaucgcugg

SEQ ID NO: 140680 - RNA, 20 nt, Artificial Sequence
  mmSKRIPTE0011459_NTC_1000
  gRNA
uuuuuagaccuaauucgcgc

SEQ ID NO: 140681 - DNA, 18 bp, Artificial Sequence
  5 prime adaptor for sgRNA library construction
ggaaaggacgaaacaccg

SEQ ID NO: 140682 - DNA, 34 bp, Artificial Sequence
  3 prime adaptor for sgRNA library construction
gttttagagctagaaatagcagttaaaataaggc

SEQ ID NO: 140683 - protein, 60 aa, Macropus
EIQEARLKLPILSEEQVIMEAVAENPTVIICGETGSGKTTQVPQFLYEAGYSSEEGLIGI

SEQ ID NO: 140684 - protein, 60 aa, Macropus
VFRPPPEGCRLCVVATNVAETSLTIPGVKYVVDCGKVKKRFYDKVTGVSSERVTWVSQAS

SEQ ID NO: 140685 - protein, 60 aa, Sus
EMQEERLKLPILASEQVIMEAVAEHPIVIVCGETGSGKTTQVPQFLYEAGYSREGGMVGP

SEQ ID NO: 140686 - protein, 57 aa, Sus
LWRRPPGICCAGCSGGALPGLSLAGLQHSVCTPPGSRSRTRGRGVKEISIAKVPGAS

SEQ ID NO: 140687 - protein, 60 aa, Tursiops
EMQAERLKLPILSEEQVIMEAVAEHPVVIVCGETGSGKTTQVPQFLYEAGYSSDNSIIGV

SEQ ID NO: 140688 - protein, 60 aa, Tursiops
VFQPPPEGTRLCVVATNVAETSLTIPGIKYVVDCGKVKKRYYDRVTGVSSERITWVSQAS

SEQ ID NO: 140689 - protein, 60 aa, Ornithorhynchus
EIQEARLKLPILSEEQVIMEAVTENPIVIICGETGSGKTTQVPQFLYEAGYASRDSIIGI

SEQ ID NO: 140690 - protein, 60 aa, Ornithorhynchus
VFKPPPEGTRLCVIATNVAETSLTIPNIKYVVDCGKVKKRFYDKVTGVSSERVSWTSQAS

SEQ ID NO: 140691 - protein, 59 aa, Monodelphis
EVQEARLRLPILSEEQVIMEAVSENPTVIVCGETGSGKTTQVPQFLYEAGYSSDGLIGI

SEQ ID NO: 140692 - protein, 60 aa, Monodelphis
VFRPPPEGRRLCVVATNVAETSLTIPGIKYVVDCGKVKKRFYDRVTGVSSFRVTWVSQAS

SEQ ID NO: 140693 - protein, 49 aa, Microcebus
  misc_feature (4)..(49): Xaa can be any naturally occurring amino acid
EMQXXXXXXXXXXXXXXXXXXXXXXXXXXXXXXXXXXXXXXXXXXXXXX

SEQ ID NO: 140694 - protein, 60 aa, Microcebus
VFKPPPEGTRLCVVATNVAETSLTIPGIKYVVDCGKVKKRYYDRVTGVSSFRVTWVSQAS

SEQ ID NO: 140695 - protein, 60 aa, Ochotona
EMQEERLKLPILSEEQVIMEAVAEHPIVIVCGETGSGKTTQVPQFLYEAGYSSDDSIIGV

SEQ ID NO: 140696 - protein, 59 aa, Ochotona
VFRPSEGARLCVVATNVAETSLTIPGIKYVVDCGKVKKRYYDRVTGVSSFRITWVSQAS

SEQ ID NO: 140697 - protein, 60 aa, Cavia
EMQAERLQLPILSEEQVIMEAVAEHPIVIVCGETGSGKTTQVPQFLYEAGYSSNNSIIGV

SEQ ID NO: 140698 - protein, 60 aa, Cavia
VFRPPEEGTRLCVVATNVAETSLTIPGIKYVVDCGKVKKRYYDRVTGVSSFRVTWVSQAS

SEQ ID NO: 140699 - protein, 58 aa, Dasypus
EMQEERLKLPILSEEQVIMEAVAEHPWSSCAETGEKTTQVPQFLYEAGYGSENSVIGV

SEQ ID NO: 140700 - protein, 53 aa, Dasypus
VFRPPPEGTRLCVVATNVAETSLTIPGIKYVDNSHTIQLSHINCPAQWTSQSP

SEQ ID NO: 140701 - protein, 60 aa, Dipodomys
EMQEERLKLPILSEEQTIMEAVAEHPVVIVCGETGSGKTTQVPQFLYEAGYSSDQSIIGV

SEQ ID NO: 140702 - protein, 60 aa, Dipodomys
VFRPPPEGARLCVVATNVAETSLTIPGIKYVVDCGKVKKRYYDRVTGVSSFRVTWISQAS

SEQ ID NO: 140703 - protein, 60 aa, Rattus
EMQEERLKLPILAEEQAIMEAVAEHPIVIVCGETGSGKTTQVPQFLYEAGYSSEDSIIGV

SEQ ID NO: 140704 - protein, 60 aa, Rattus
VFKPPPEGTRLCVIATNVAETSLTIPGIKYVVDCGKVKKRYYDRVTGVSSFRVTWVSQAS

SEQ ID NO: 140705 - protein, 60 aa, Mus; identical to SEQ ID NO: 140703

SEQ ID NO: 140706 - protein, 60 aa, Mus; identical to SEQ ID NO: 140694

SEQ ID NO: 140707 - protein, 60 aa, Procavia
EMQEERLKLPILAEEQVIMEAVAENPIVIVCGETGSGKTTQVPQFLYEAGYSSDGSYIGV

SEQ ID NO: 140708 - protein, 60 aa, Procavia
VFAPPPEGTRLCVVATNVAETSLTIPGIKYVVDCGKVKKRYYDRVTSVSSFRVTWISQAS

SEQ ID NO: 140709 - protein, 60 aa, Bos
EMQEERLKLPILSEEQVIMEAVAEHPIVIICGETGSGKTTQVPQFLYEAGYSSDNSVIGV

SEQ ID NO: 140710 - protein, 60 aa, Bos
VFQPPPEGTRLCVVATNVAETSLTIPGIKYVVDCGKVKKRHYDRVTGVSSFRVTWVSQAS

SEQ ID NO: 140711 - protein, 60 aa, Pteropus
EMQEERLKLPILSEEQVIMEAVAEHPVVIVCGETGSGKTTQVPQFLYEAGYSSDDSIIGV

SEQ ID NO: 140712 - protein, 60 aa, Pteropus
VFQPPPEGTRLCVVATNVAETSLTIPGIKYVVDCGKVKKRHYDRVTGVSSFRITWVSQAS

SEQ ID NO: 140713 - protein, 60 aa, Felis
EGQEERLKLPILAEEQVIMEAVAEHPIVIVCGETGSGKTTQVPQFLYEAGYTSDDSIIGI

SEQ ID NO: 140714 - protein, 60 aa, Felis
VFQPPPEGTRLCVVATNVAETSLTIPGIKYVVDCGKVKRRHYDRVTGVSSFRVTWVSQAS

SEQ ID NO: 140715 - protein, 60 aa, Mustela
EMQEERLKLPILAEEQAIMEAVAEHPIVIVCGETGSGKTTQVPQFLYEAGYSSDNSIIGI

SEQ ID NO: 140716 - protein, 60 aa, Mustela; identical to SEQ ID NO: 140710

SEQ ID NO: 140717 - protein, 60 aa, Canis
EMQEERLKLPILAEEQVIMEAVAEHPIVIVCGETGSGKTTQVPQFLYEAGYSSDNSIIGI

SEQ ID NO: 140718 - protein, 60 aa, Canis; identical to SEQ ID NO: 140710

SEQ ID NO: 140719 - protein, 60 aa, Ailuropoda; identical to SEQ ID NO: 140717

SEQ ID NO: 140720 - protein, 60 aa, Ailuropoda; identical to SEQ ID NO: 140710

SEQ ID NO: 140721 - protein, 60 aa, Equus
EMQEERLKLPILSEEQVIMEAVAEHPIVIVCGETGSGKTTQVPQFLYEAGYSSDNSIIGV

SEQ ID NO: 140722 - protein, 60 aa, Equus
VFKPPPEGTRLCVVATNVAETSLTIPGIKYVVDCGKVKKRHYDRVTGVSSFRVTWVSQAS

SEQ ID NO: 140723 - protein, 60 aa, Ictidomys
EMQEERLKLPILAEEQVIMEAVADNPIVIVCGETGSGKTTQVPQFLYEAGYSSDDSIIGV

SEQ ID NO: 140724 - protein, 60 aa, Ictidomys
VFRPPPEGTRLCVVATNVAETSLTIPGIKYVVDCGKVKKRFYDRVTGVSSFRVTWVSQAS

SEQ ID NO: 140725 - protein, 60 aa, Oryctolagus
EMQEERLKLPILSEEQVIMEAVAEHPIVIVCGETGSGKTTQVPQFLYEAGYSSDDGIIGV

SEQ ID NO: 140726 - protein, 59 aa, Oryctolagus
VFRPPPEGTRLCVVATHVAETSLTIPGIKYVVDCKVKKRYYDRVTGVSSFRVTWISQAS

SEQ ID NO: 140727 - protein, 60 aa, Loxodonta
EMQEERLKLPILAEEQVIMEAVAENPIIIVCGETGSGKTTQVPQFLYEAGYSSDDSIIGV

SEQ ID NO: 140728 - protein, 60 aa, Loxodonta
VFTPPPEGTRLCVVATNVAETSLTIPGIKYVVDCGKVKKRYYDRVTSVSSFRVTWVSQAS

SEQ ID NO: 140729 - protein, 60 aa, Otolemur
EIQEERLKLPILSEEQVIMEAVAEHPVVIVCGETGSGKTTQVPQFLYEAGYSSDNSIIGV

SEQ ID NO: 140730 - protein, 60 aa, Otolemur; identical to SEQ ID NO: 140704

SEQ ID NO: 140731 - protein, 60 aa, Nomascus
EMQEERLKLPILSEEQVIMEAVAEHPIVIVCGETGSGKTTQVPQFLYEAGYSSEDSIIGV

SEQ ID NO: 140732 - protein, 60 aa, Nomascus
VFKPPPEGIRLCVVATNVAETSLTIPGIKYVVDCGKVKKRYYDRVTGVSSFRVTWVSQAS

SEQ ID NO: 140733 - protein, 60 aa, Callithrix
EMQEERLKLPILAEEQVIMEAVAEHPIIIVCGETGSGKTTQVPQFLYEAGYSSEGSIIGV

SEQ ID NO: 140734 - protein, 60 aa, Callithrix
VFKPPPEGTRLCVVATNVAETSLTIPGIKYVVDCGKVKKRDYDRVTGVSSFRVTWVSQAS

SEQ ID NO: 140735 - protein, 60 aa, Macaca; identical to SEQ ID NO: 140731

SEQ ID NO: 140736 - protein, 60 aa, Macaca; identical to SEQ ID NO: 140694

SEQ ID NO: 140737 - protein, 60 aa, Papio
EMQEERLKLPILSEEQVIMEAVTEHPIVIVCGETGSGKTTQVPQFLYEAGYSSEGSIIGV

SEQ ID NO: 140738 - protein, 60 aa, Papio; identical to SEQ ID NO: 140694

SEQ ID NO: 140739 - protein, 60 aa, Chlorocebus; identical to SEQ ID NO: 140731

SEQ ID NO: 140740 - protein, 60 aa, Chlorocebus
VFKPPPEGTRLCVVATNVAETSLTIPGIKYVVDCGKVKKRYYDRVTGVSSFCVTWVSQAS

SEQ ID NO: 140741 - protein, 52 aa, Pongo
EMQEERLKLPILSEEQVIMEAVAEHPIVIVCGETGSGKTTQVPQFLYEAGYS

SEQ ID NO: 140742 - protein, 60 aa, Pongo; identical to SEQ ID NO: 140694

SEQ ID NO: 140743 - protein, 59 aa, Gorilla
EMQEERLKLPILSEEQVIMEAVAEHPIVIVCGETGSGKTTQVQFLYEAGFSSEDSIIGV

SEQ ID NO: 140744 - protein, 60 aa, Gorilla
VFKPPPEGTRLCVVATNVAETSLTIPGIKYVVDCGKVKKRYYDRVTGVSSFRYTWVSQAS

SEQ ID NO: 140745 - protein, 60 aa, Homo
EMQEERLKLPILSEEQVIMEAVAEHPIVIVCGETGSGKTTQVPQFLYEAGFSSEDSIIGV

SEQ ID NO: 140746 - protein, 60 aa, Homo
VFKPPPEGTRLCVVATNVEATSLTIPGIKYVVDCGKVKKRYYDRVTGVSSFRVTWVSQAS

SEQ ID NO: 140747 - protein, 60 aa, Procavia
IYWPNGLTLDYAERKLYWADAKLNFIHKSNLDGTNRQAVVKGSLPHPFALTLFEDTLYWT

SEQ ID NO: 140748 - protein, 60 aa, Procavia
RVVLVNTSLGWPNGLALDYDEGKIYWGDAKTDKIEVMSTDGTGRRVLVEDKIPHIFGFTL

SEQ ID NO: 140749 - protein, 60 aa, Macropus
IYWPNGLTLDYEEEKLYWADAKLNFIHKSNLDGTNRQAVVRGSLPHPFALTLFEDTLYWT

SEQ ID NO: 140750 - protein, 58 aa, Macropus
RVVLVNTSLGWPNGLALDYDEDKIYWGDAKTDKIEVMKADGSGKVFVEDKFAQKFLIL

SEQ ID NO: 140751 - protein, 60 aa, Erinaceus
  misc_feature (1)..(36): Xaa can be any naturally occurring amino acid
XXXXXXXXXXXXXXXXXXXXXXXXXXXXXXXXXXXXQAVVKGSLPHPFALTLFEDTLYWT

SEQ ID NO: 140752 - protein, 60 aa, Erinaceus
  misc_feature (36)..(60): Xaa can be any naturally occurring amino acid
RVVLVNTSLGWPNGLALDYDEGKIYWGDAKTDKIEXXXXXXXXXXXXXXXXXXXXXXXXX

SEQ ID NO: 140753 - protein, 60 aa, Ochotona; identical to SEQ ID NO: 140751
  misc_feature (1)..(36): Xaa can be any naturally occurring amino acid

SEQ ID NO: 140754 - protein, 60 aa, Ochotona
RVVLVNTSLGWPNGLALDYDEGKIYWGDAKTDKIEVMNTDGTARRVLVEDKIPHIFGFTL

SEQ ID NO: 140755 - protein, 60 aa, Microcebus
IYWPNGLTLDYEERKLYWADAKLNFIHKSNLDGTNRQAVVKGSLPHPFALTLFEDTLYWT

SEQ ID NO: 140756 - protein, 60 aa, Microcebus; identical to SEQ ID NO: 140752
  misc_feature (36)..(60): Xaa can be any naturally occurring amino acid

SEQ ID NO: 140757 - protein, 60 aa, Vicugna; identical to SEQ ID NO: 140751
  misc_feature (1)..(36): Xaa can be any naturally occurring amino acid

SEQ ID NO: 140758 - protein, 60 aa, Vicugna
RVVLVNTSLGWPNGLALDYDEGKIYWGDAKTDKIEVMNTDGTGRRVLVEDKIPHIFGFTL

SEQ ID NO: 140759 - protein, 60 aa, Choloepus
IYWPNGLTLDYEEQKLYWADAKLNFIHKSNLDGTNRQAVVKGSLPHPFALTLFEDTLYWT

SEQ ID NO: 140760 - protein, 60 aa, Choloepus
  misc_feature (36)..(60): Xaa can be any naturally occurring amino acid
RVVLVNASLGWPNGLALDYDEGKIYWGDAKTDKIEXXXXXXXXXXXXXXXXXXXXXXXXX

SEQ ID NO: 140761 - protein, 60 aa, Echinops
IYWPNGLTVDYEEQKLYWADAKLNFIHKANVDGTNRQAVVKGSLPHPFALTLFEDTLYWT

SEQ ID NO: 140762 - protein, 60 aa, Echinops
RVVLVNTSLGWPNGLALDYDEMKIYWGDAKTDKIEVINTDGSGRRVLVEDKIPHIFGFTL

SEQ ID NO: 140763 - protein, 59 aa, Tarsius
  misc_feature (1)..(35): Xaa can be any naturally occurring amino acid
XXXXXXXXXXXXXXXXXXXXXXXXXXXXXXXXXXXQAVVKGSLPHPFALTLFEDTLYWT

SEQ ID NO: 140764 - protein, 60 aa, Tarsius; identical to SEQ ID NO: 140758

SEQ ID NO: 140765 - protein, 60 aa, Sorex; identical to SEQ ID NO: 140755

SEQ ID NO: 140766 - protein, 60 aa, Sorex; identical to SEQ ID NO: 140758

SEQ ID NO: 140767 - protein, 60 aa, Pteropus; identical to SEQ ID NO: 140759

SEQ ID NO: 140768 - protein, 60 aa, Pteropus; identical to SEQ ID NO: 140758

SEQ ID NO: 140769 - protein, 60 aa, Tupaia; identical to SEQ ID NO: 140755

SEQ ID NO: 140770 - protein, 60 aa, Tupaia
RIVLVNTSLGWPNGLALDYDEGKIYWGDAKTDKIEVMNTDGTGRRVLVEDKIPHIFGFTL

SEQ ID NO: 140771 - protein, 60 aa, Ornithorhynchus
IYWPNGLTLDYKERKLYWADAKLNFIHKSNLDGTDRQAVVKGSLPHPFALTLFEDTLYWT

SEQ ID NO: 140772 - protein, 60 aa, Ornithorhynchus
RTVLVNTSLGWPNGLALDYDEGKIYWGDAKTDKIEVMNADGSGRRVLVEDKIPHIFGFTL

SEQ ID NO: 140773 - protein, 60 aa, Monodelphis; identical to SEQ ID NO: 140749

SEQ ID NO: 140774 - protein, 60 aa, Monodelphis
RVVLVNTSLGWPNGLALDYDEDKIYWGDAKTDKIEVMNADGTGRRVLVEDKIPHIFGFTL

SEQ ID NO: 140775 - protein, 60 aa, Sarcophilus; identical to SEQ ID NO: 140749

SEQ ID NO: 140776 - protein, 60 aa, Sarcophilus
RVVLVNTSLGWPNGLALDYDEEKIYWGDAKTDKIEVMNADGTGRRVLVEDKIPHIFGFTL

SEQ ID NO: 140777 - protein, 60 aa, Tursiops
IYWPNGLTLDYKERKLYWADAKLNFIHRSNLDGTNRQAVVKGSLPHPFALTLFEDTLYWT

SEQ ID NO: 140778 - protein, 60 aa, Tursiops; identical to SEQ ID NO: 140758

SEQ ID NO: 140779 - protein, 60 aa, Mus
IYWPNGLTLDYQERKLYWADAKLNFIHKSNLDGTNRQAVVKGSLPHPFALTLFEDTLYWT

SEQ ID NO: 140780 - protein, 60 aa, Mus
RVVLVNTSLGWPNGLALDYDEGTIYWGDAKTDKIEVMNTDGTGRRVLVEDKIPHIFGFTL

SEQ ID NO: 140781 - protein, 60 aa, Rattus; identical to SEQ ID NO: 140755

SEQ ID NO: 140782 - protein, 60 aa, Rattus; identical to SEQ ID NO: 140780

SEQ ID NO: 140783 - protein, 60 aa, Callithrix; identical to SEQ ID NO: 140755

SEQ ID NO: 140784 - protein, 60 aa, Callithrix
RVVLVNTSLGWPNGLALDYDEGKVYWGDAKTDKIEVVNTDGSGRRVLVEDKIPHIFGFTL

SEQ ID NO: 140785 - protein, 59 aa, Ovis
IYWPNGLTLDYEERKLYWADAKLNFIHRSNLDGTRQAVVKGSLPHPFALTLFEDTLYWT

SEQ ID NO: 140786 - protein, 60 aa, Ovis; identical to SEQ ID NO: 140758

SEQ ID NO: 140787 - protein, 60 aa, Bos
IYWPNGLTLDYEERKLYWADAKLNFIHRSNLDGTTRQAVVKGSLPHPFALTLFEDTLYWT

SEQ ID NO: 140788 - protein, 60 aa, Bos; identical to SEQ ID NO: 140758

SEQ ID NO: 140789 - protein, 60 aa, Chlorocebus
IYWPNGLTLDYEEQKLYWADAKLNFIHKSNLDGTNRQAVVKGSLPHPFALTLFEDILYWT

SEQ ID NO: 140790 - protein, 60 aa, Chlorocebus; identical to SEQ ID NO: 140758

SEQ ID NO: 140791 - protein, 60 aa, Macaca; identical to SEQ ID NO: 140789

SEQ ID NO: 140792 - protein, 60 aa, Macaca; identical to SEQ ID NO: 140758

SEQ ID NO: 140793 - protein, 60 aa, Papio; identical to SEQ ID NO: 140789

SEQ ID NO: 140794 - protein, 60 aa, Papio; identical to SEQ ID NO: 140758

SEQ ID NO: 140795 - protein, 60 aa, Homo; identical to SEQ ID NO: 140789

SEQ ID NO: 140796 - protein, 60 aa, Homo; identical to SEQ ID NO: 140758

SEQ ID NO: 140797 - protein, 60 aa, Nomascus; identical to SEQ ID NO: 140789

SEQ ID NO: 140798 - protein, 60 aa, Nomascus
RVILVNTSLGWPNGLALDYDEGKIYWGDAKTDKIEVMNTDGTGRRVLVEDKIPHIFGFTL

SEQ ID NO: 140799 - protein, 60 aa, Gorilla; identical to SEQ ID NO: 140789

SEQ ID NO: 140800 - protein, 60 aa, Gorilla; identical to SEQ ID NO: 140758

SEQ ID NO: 140801 - protein, 60 aa, Pan; identical to SEQ ID NO: 140789

SEQ ID NO: 140802 - protein, 60 aa, Pan; identical to SEQ ID NO: 140758

SEQ ID NO: 140803 - protein, 60 aa, Dasypus; identical to SEQ ID NO: 140755

SEQ ID NO: 140804 - protein, 60 aa, Dasypus; identical to SEQ ID NO: 140758

SEQ ID NO: 140805 - protein, 60 aa, Otolemur; identical to SEQ ID NO: 140755

SEQ ID NO: 140806 - protein, 60 aa, Otolemur
RVVLVNTSLGWPNGLALDYEESKIYWGDAKTDKIEVMNTDGTGRRVLVEDKIPHIFGFTL

SEQ ID NO: 140807 - protein, 60 aa, Myotis
IYWPNGLTLDYEERKLYWADAKLNFIHKSNLDGTDRQAVVKGSLPHPFALTLFEDTLYWT

SEQ ID NO: 140808 - protein, 60 aa, Myotis; identical to SEQ ID NO: 140758

SEQ ID NO: 140809 - protein, 60 aa, Loxodonta; identical to SEQ ID NO: 140755

SEQ ID NO: 140810 - protein, 60 aa, Loxodonta; identical to SEQ ID NO: 140758

SEQ ID NO: 140811 - protein, 60 aa, Sus; identical to SEQ ID NO: 140755

SEQ ID NO: 140812 - protein, 60 aa, Sus; identical to SEQ ID NO: 140758

SEQ ID NO: 140813 - protein, 60 aa, Oryctolagus; identical to SEQ ID NO: 140755

SEQ ID NO: 140814 - protein, 60 aa, Oryctolagus; identical to SEQ ID NO: 140758

SEQ ID NO: 140815 - protein, 60 aa, Cavia; identical to SEQ ID NO: 140755

SEQ ID NO: 140816 - protein, 60 aa, Cavia; identical to SEQ ID NO: 140758

SEQ ID NO: 140817 - protein, 60 aa, Equus; identical to SEQ ID NO: 140755

SEQ ID NO: 140818 - protein, 60 aa, Equus; identical to SEQ ID NO: 140758

SEQ ID NO: 140819 - protein, 60 aa, Felis; identical to SEQ ID NO: 140759

SEQ ID NO: 140820 - protein, 60 aa, Felis
RVVLVNTSLGWPNGLALDYDEGKIYWGDAKTDKIEVMNIDGTGRRVLVEDKIPHIFGFTL

SEQ ID NO: 140821 - protein, 60 aa, Canis; identical to SEQ ID NO: 140759

SEQ ID NO: 140822 - protein, 60 aa, Canis; identical to SEQ ID NO: 140758

SEQ ID NO: 140823 - protein, 60 aa, Mustela; identical to SEQ ID NO: 140759

SEQ ID NO: 140824 - protein, 60 aa, Mustela; identical to SEQ ID NO: 140758

SEQ ID NO: 140825 - protein, 60 aa, Ailuropoda; identical to SEQ ID NO: 140759

SEQ ID NO: 140826 - protein, 60 aa, Ailuropoda; identical to SEQ ID NO: 140758

SEQ ID NO: 140827 - protein, 60 aa, Erinaceus
TAKACAQTVLAVLHYEEAKSFLWWASNLMVLGGSFAYTWVRGWEMKRVQEEPGPREDQKS

SEQ ID NO: 140828 - protein, 60 aa, Monodelphis
TAKACAQTVLAVLYFNETKSFLWWTSNLMVLGGSSAYTWVKGLEMKKAQGEPSPKEGEKS

SEQ ID NO: 140829 - protein, 60 aa, Sarcophilus
TAKACAQTVLAVLYFEETKSFLWWTSNLMVLGGSSAYTWVKGLEMKKAQEELAPREGEKG

SEQ ID NO: 140830 - protein, 60 aa, Tursiops
TAKACAQTVLAVLYYEETKSFLWWMSNMMVLGGSSAYTWVRGWEMKKIQEEPRPKEDEKS

SEQ ID NO: 140831 - protein, 45 aa, Echinops
TAKACAQTVLAVMMVLGGSWAYTCVRGWEMKKVQEEPSPKEDEKS

SEQ ID NO: 140832 - protein, 60 aa, Ornithorhynchus
TAKACAQTVLAVLSYEETKSFLWWTSNMMVLGGSSAYTWVKGLEMKKAQEEPGPKAGEKG

SEQ ID NO: 140833 - protein, 60 aa, Rattus
TAKACAQTVLAVLYYEEIKSFLWWTSNLMVLGGSSAYTWVRGWEMQKTQEDPSSKEGEKS

SEQ ID NO: 140834 - protein, 60 aa, Mus
TAKACAQTVLAVLYYEEIKSFLWWTSNLMVLGGSSAYTWVRGWEMQKTQEDPSSKDGEKS

SEQ ID NO: 140835 - protein, 60 aa, Dasypus
TAKACAQTVLAVLYFEETKSLLWWTSNMMVLGGSSTYTWVRGWEMKKVQEEPSPREDEKN

SEQ ID NO: 140836 - protein, 60 aa, Ovis
TAKACAQTVLAVLYYEEAKSFLWWTSNMMVLGGSSAYTWVRGREMKKTQEEPHPRENEKS

SEQ ID NO: 140837 - protein, 60 aa, Bos; identical to SEQ ID NO: 140836

SEQ ID NO: 140838 - protein, 60 aa, Otolemur
TAKACAQTVLAVLYYEETKSFLWWTSNMMVLGGSSAYTWVRGWEMKKTQEEPSPKEDEKS

SEQ ID NO: 140839 - protein, 60 aa, Microcebus
TAKACAQTVLAVLYYEETKSFLWWTSNMMVLGGSSAYTWVRGWEMKKTQEEPSPKEGEKS

SEQ ID NO: 140840 - protein, 60 aa, Loxodonta
TAKACAQTVLAVLYYEETKSFLWWTSNMMVLGGSSAYTWVRGWEMKKVQEEPSPKEGEKS

SEQ ID NO: 140841 - protein, 60 aa, Procavia
TAKACAQTVLAVLYYEETKSFLWWTSNMMVLGGSSAYTWVRGWEMKKLQEEPSPRESEKI

SEQ ID NO: 140842 - protein, 60 aa, Dipodomys
TAKACAQTVLAVLYYEETKSFLWWTSNLMVLGGSSAYTWVRGWEMKKTPEDPSPKEGEKS

SEQ ID NO: 140843 - protein, 59 aa, Ictidomys
TAKACAQTVLAVLYFEETKSFLWWTSNAMVLGGSSAYTWVRGWEMKSQEDPGPREGEKS

SEQ ID NO: 140844 - protein, 60 aa, Ochotona
TAKACAQTVLAVLYYEETKSFLWWTSNLMVLGGSSAYTWVRGWEMQKVQHDPSPKENEKS

SEQ ID NO: 140845 - protein, 59 aa, Oryctolagus
TAKACAQTVLAVLYYEEAKSFLWWTSNLMVLGGSSAYTWVRGWEKKEQEDPSPKEGDKS

SEQ ID NO: 140846 - protein, 60 aa, Cavia
TAKACFQTVLAVLYYEETKSFLWWTSNLMVLGGSSAYTWVRGWEMKKVQEDPSPREDEKS

SEQ ID NO: 140847 - protein, 60 aa, Pteropus
TAKACAQTVLAVLYYEETKSFLWWTSNMMVLGGSSAYTWVRGWEMKKIQEDPSPKEDEKS

SEQ ID NO: 140848 - protein, 60 aa, Canis; identical to SEQ ID NO: 140847

SEQ ID NO: 140849 - protein, 60 aa, Felis
TTKACAQTVLAVLYYEETKSFLWWTSNMMVLGGSSAYTWVRGWEMKKIQEEPSPKEDEKS

SEQ ID NO: 140850 - protein, 60 aa, Mustela
TAKACAQTVLAVLYYEETKSFLWWTSNMMVLGGSSAYTWVRGWEMKKIQEEPSPKEEEKS

SEQ ID NO: 140851 - protein, 60 aa, Ailuropoda
TAKACAQTVLAVLYYEETKSFLWWTSNLMVLGGSSAYTWVRGWEMKKIQEEPSPKEEEKS

SEQ ID NO: 140852 - protein, 60 aa, Myotis
TAKACAQTVLAVLYYEETKSFLWWTSNMMVLGGSSAYTWVRGWEMKKVQEEPSPKDNEKS

SEQ ID NO: 140853 - protein, 60 aa, Equus
TAKACAQTVLAVLYYEETKSFLWWTSNMMVLGGSSAYTWVRGWEMKKVQEEPSPKEEEKS

SEQ ID NO: 140854 - protein, 60 aa, Tarsius
TAKACAQTVLAVLYYEETKSFFWWMSNMMVLGGSSAYTWVRGWEMKKTQEEPSPKEDEKS

SEQ ID NO: 140855 - protein, 60 aa, Chlorocebus
TAKACAQTVLAVLYYEEAKSFLWWTSNMMVLGGSSAYTWVRGWEMKKIPEEPSPKEGEKS

SEQ ID NO: 140856 - protein, 60 aa, Macaca; identical to SEQ ID NO: 140855

SEQ ID NO: 140857 - protein, 60 aa, Papio; identical to SEQ ID NO: 140855

SEQ ID NO: 140858 - protein, 60 aa, Callithrix
TAKACAQTVLAVLYYEETKSFLWWTSNMMVLGGSSAYTWVRGREMKKTPEELSPKEGEKS

SEQ ID NO: 140859 - protein, 60 aa, Gorilla
TAKACAQTVLAVLYYEETKSFLWWTSNMMVLGGSSAYTWVRGWEMKKTPEEPSPKDSEKS

SEQ ID NO: 140860 - protein, 60 aa, Pan
TAKACAQTVLAVLYYEETKSFLWWTSNMMVLGGSSAYTWVRGWEMKKSPEEPSPKDSEKS

SEQ ID NO: 140861 - protein, 60 aa, Homo; identical to SEQ ID NO: 140859

SEQ ID NO: 140862 - protein, 60 aa, Pongo
TAKACAQTVLAVLYYEETKSFLWWTSNMMVLGGSSAYTWVRGWEMKKTPEEPSPKEGEKS

SEQ ID NO: 140863 - protein, 60 aa, Nomascus; identical to SEQ ID NO: 140839

SEQ ID NO: 140864 - DNA, 38 bp, Mus musculus
ctaacctcatagctgttaggaattctcacgtgaagaag

SEQ ID NO: 140865 - DNA, 39 bp, Mus musculus
ctaacctcataagctgttaggaattctcacgtgaagaag

SEQ ID NO: 140866 - DNA, 31 bp, Mus musculus
ctaacctcataggaattctcacgtgaagaag

SEQ ID NO: 140867 - DNA, 37 bp, Mus musculus
ctaacctcatactgttaggaattctcacgtgaagaag

SEQ ID NO: 140868 - DNA, 36 bp, Mus musculus
ctaacctcatatgttaggaattctcacgtgaagaag

SEQ ID NO: 140869 - DNA, 36 bp, Mus musculus
ctaacctcagctgttaggaattctcacgtgaagaag

SEQ ID NO: 140870 - DNA, 37 bp, Mus musculus
ctaacctcatgctgttaggaattctcacgtgaagaag

SEQ ID NO: 140871 - DNA, 34 bp, Mus musculus
ctaacctcatattaggaattctcacgtgaagaag

SEQ ID NO: 140872 - DNA, 35 bp, Mus musculus
ctaacctcatagttaggaattctcacgtgaagaag

SEQ ID NO: 140873 - DNA, 37 bp, Mus musculus
ctaacctcaagctgttaggaattctcacgtgaagaag

SEQ ID NO: 140874 - DNA, 33 bp, Mus musculus
ctaacctcatataggaattctcacgtgaagaag

SEQ ID NO: 140875 - DNA, 40 bp, Mus musculus
cagtcgcggtcgcttcagtcgtcagcatggctcgctcggt

SEQ ID NO: 140876 - DNA, 41 bp, Mus musculus
cagtcgcggtcgcttcagtcagtcagcatggctcgctcggt

SEQ ID NO: 140877 - DNA, 38 bp, Mus musculus
cagtcgcggtcgcttcaggtcagcatggctcgctcggt

SEQ ID NO: 140878 - DNA, 40 bp, Mus musculus; identical to SEQ ID NO: 140875

SEQ ID NO: 140879 - DNA, 28 bp, Mus musculus
cagtcgcggtcgcttcagttcgctcggt

SEQ ID NO: 140880 - DNA, 39 bp, Mus musculus
cagtcgcggtcgcttcagtcgtagcatggctcgctcggt

SEQ ID NO: 140881 - DNA, 37 bp, Mus musculus
cagtcgcggtcgcttcagtcagcatggctcgctcggt

SEQ ID NO: 140882 - DNA, 37 bp, Mus musculus
cagtcgcggtcgcttcagtcgtcatggctcgctcggt

SEQ ID NO: 140883 - DNA, 36 bp, Mus musculus
cagtcgcggtcgcttcagtcgcatggctcgctcggt

SEQ ID NO: 140884 - DNA, 30 bp, Mus musculus
cagtcgcggtcgcttcatggctcgctcggt

SEQ ID NO: 140885 - DNA, 34 bp, Mus musculus
cagtcgcggtcgcttcaagcatggctcgctcggt

SEQ ID NO: 140886 - DNA, 40 bp, Mus musculus
cagggacaagttgcctacctatagcagtggcctggctctg

SEQ ID NO: 140887 - DNA, 38 bp, Mus musculus
cagggacaagttgcctacctatcagtggcctggctctg

SEQ ID NO: 140888 - DNA, 39 bp, Mus musculus
cagggacaagttgcctacctatagagtggcctggctctg

SEQ ID NO: 140889 - DNA, 39 bp, Mus musculus
cagggacaagttgcctacctatacagtggcctggctctg

SEQ ID NO: 140890 - DNA, 37 bp, Mus musculus
cagggacaagttgcctacctatagtggcctggctctg

SEQ ID NO: 140891 - DNA, 37 bp, Mus musculus
cagggacaagttgcctacctacagtggcctggctctg

SEQ ID NO: 140892 - DNA, 41 bp, Mus musculus
cagggacaagttgcctacctatagtcagtggcctggctctg

SEQ ID NO: 140893 - DNA, 36 bp, Mus musculus
cagggacaagttgcctacctcagtggcctggctctg

SEQ ID NO: 140894 - DNA, 41 bp, Mus musculus
cagggacaagttgcctacctatagccagtggcctggctctg

SEQ ID NO: 140895 - DNA, 35 bp, Mus musculus
cagggacaagttgcctacccagtggcctggctctg

SEQ ID NO: 140896 - DNA, 23 bp, Mus musculus
cagggacaagttgcctggctctg

SEQ ID NO: 140897 - DNA, 20 bp, Artificial Sequence
  primer
gttttagagctagaaatggc

SEQ ID NO: 140898 - DNA, 20 bp, Artificial Sequence
  primer
gtggaaaggacgaaacaccg
